United States Patent 11,464,842 (COMPOSITIONS AND METHOD FOR OPTIMIZED PEPTIDE VACCINES USING RESIDUE OPTIMIZATION) - sequence listing, part 40

SEQ ID NO: 334374 - protein, 16 aa, Artificial Sequence
  Description of Artificial Sequence: Synthetic peptide
  Seed: PTTEVVGTTPGQAPTA (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTA

SEQ ID NO: 334375 - protein, 17 aa, Artificial Sequence
  Description of Artificial Sequence: Synthetic peptide
  Seed: PTTEVVGTTPGQAPTAE (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTAE

SEQ ID NO: 334376 - protein, 18 aa, Artificial Sequence
  Description of Artificial Sequence: Synthetic peptide
  Seed: PTTEVVGTTPGQAPTAEP (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTAEP

SEQ ID NO: 334377 - protein, 19 aa, Artificial Sequence
  Description of Artificial Sequence: Synthetic peptide
  Seed: PTTEVVGTTPGQAPTAEPS (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTAEPS

SEQ ID NO: 334378 - protein, 19 aa, Artificial Sequence
  Description of Artificial Sequence: Synthetic peptide
  Seed: PTTEVVGTTPGQAPTAEPS (PMEL_HUMAN)
  Core: TTPGQAPTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVVGXTPXQXPTXEPS

SEQ ID NO: 334379 - protein, 20 aa, Artificial Sequence
  Description of Artificial Sequence: Synthetic peptide
  Seed: PTTEVVGTTPGQAPTAEPSG (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTAEPSG

SEQ ID NO: 334380 - protein, 20 aa, Artificial Sequence
  Description of Artificial Sequence: Synthetic peptide
  Seed: PTTEVVGTTPGQAPTAEPSG (PMEL_HUMAN)
  Core: TTPGQAPTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVVGXTPXQXPTXEPSG

SEQ ID NO: 334381 - protein, 21 aa, Artificial Sequence
  Description of Artificial Sequence: Synthetic peptide
  Seed: PTTEVVGTTPGQAPTAEPSGT (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTAEPSGT

SEQ ID NO: 334382 - protein, 21 aa, Artificial Sequence
  Description of Artificial Sequence: Synthetic peptide
  Seed: PTTEVVGTTPGQAPTAEPSGT (PMEL_HUMAN)
  Core: TTPGQAPTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVVGXTPXQXPTXEPSGT

SEQ ID NO: 334383 - protein, 22 aa, Artificial Sequence
  Description of Artificial Sequence: Synthetic peptide
  Seed: PTTEVVGTTPGQAPTAEPSGTT (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTAEPSGTT

SEQ ID NO: 334384 - protein, 22 aa, Artificial Sequence
  Description of Artificial Sequence: Synthetic peptide
  Seed: PTTEVVGTTPGQAPTAEPSGTT (PMEL_HUMAN)
  Core: TTPGQAPTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVVGXTPXQXPTXEPSGTT

SEQ ID NO: 334385 - protein, 23 aa, Artificial Sequence
  Description of Artificial Sequence: Synthetic peptide
  Seed: PTTEVVGTTPGQAPTAEPSGTTS (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTAEPSGTTS

SEQ ID NO: 334386 - protein, 23 aa, Artificial Sequence
  Description of Artificial Sequence: Synthetic peptide
  Seed: PTTEVVGTTPGQAPTAEPSGTTS (PMEL_HUMAN)
  Core: TTPGQAPTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVVGXTPXQXPTXEPSGTTS

SEQ ID NO: 334387 - protein, 24 aa, Artificial Sequence
  Description of Artificial Sequence: Synthetic peptide
  Seed: PTTEVVGTTPGQAPTAEPSGTTSV (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTAEPSGTTSV

SEQ ID NO: 334388 - protein, 24 aa, Artificial Sequence
  Description of Artificial Sequence: Synthetic peptide
  Seed: PTTEVVGTTPGQAPTAEPSGTTSV (PMEL_HUMAN)
  Core: TTPGQAPTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVVGXTPXQXPTXEPSGTTSV

SEQ ID NO: 334389 - protein, 25 aa, Artificial Sequence
  Description of Artificial Sequence: Synthetic peptide
  Seed: PTTEVVGTTPGQAPTAEPSGTTSVQ (PMEL_HUMAN)
  Core: VVGTTPGQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PTTEXVGXTXGQXPTAEPSGTTSVQ

SEQ ID NO: 334390 - protein, 25 aa, Artificial Sequence
  Description of Artificial Sequence: Synthetic peptide
  Seed: PTTEVVGTTPGQAPTAEPSGTTSVQ (PMEL_HUMAN)
  Core: TTPGQAPTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PTTEVVGXTPXQXPTXEPSGTTSVQ

SEQ ID NO: 334391 - protein, 15 aa, Artificial Sequence
  Description of Artificial Sequence: Synthetic peptide
  Seed: PVLPSPACQLVLHQI (PMEL_HUMAN)
  Core: VLPSPACQL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXLPXPXCQXVLHQI

SEQ ID NO: 334392 - protein, 15 aa, Artificial Sequence
  Description of Artificial Sequence: Synthetic peptide
  Seed: PVLPSPACQLVLHQI (PMEL_HUMAN)
  Core: PACQLVLHQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSXACXLXLHXI

SEQ ID NO: 334393 - protein, 16 aa, Artificial Sequence
  Description of Artificial Sequence: Synthetic peptide
  Seed: PVLPSPACQLVLHQIL (PMEL_HUMAN)
  Core: VLPSPACQL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXLPXPXCQXVLHQIL

SEQ ID NO: 334394 - protein, 16 aa, Artificial Sequence
  Description of Artificial Sequence: Synthetic peptide
  Seed: PVLPSPACQLVLHQIL (PMEL_HUMAN)
  Core: ACQLVLHQI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPXCQXVXHQXL

SEQ ID NO: 334395 - protein, 16 aa, Artificial Sequence
  Description of Artificial Sequence: Synthetic peptide
  Seed: PVLPSPACQLVLHQIL (PMEL_HUMAN)
  Core: CQLVLHQIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPAXQLXLXQIX

SEQ ID NO: 334396 - protein, 17 aa, Artificial Sequence
  Description of Artificial Sequence: Synthetic peptide
  Seed: PVLPSPACQLVLHQILK (PMEL_HUMAN)
  Core: VLPSPACQL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXLPXPXCQXVLHQILK

SEQ ID NO: 334397 - protein, 17 aa, Artificial Sequence
  Description of Artificial Sequence: Synthetic peptide
  Seed: PVLPSPACQLVLHQILK (PMEL_HUMAN)
  Core: PACQLVLHQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSXACXLXLHXILK

SEQ ID NO: 334398 - protein, 17 aa, Artificial Sequence
  Description of Artificial Sequence: Synthetic peptide
  Seed: PVLPSPACQLVLHQILK (PMEL_HUMAN)
  Core: CQLVLHQIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPAXQLXLXQIXK

SEQ ID NO: 334399 - protein, 18 aa, Artificial Sequence
  Description of Artificial Sequence: Synthetic peptide
  Seed: PVLPSPACQLVLHQILKG (PMEL_HUMAN)
  Core: CQLVLHQIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPAXQLXLXQIXKG

SEQ ID NO: 334400 - protein, 18 aa, Artificial Sequence
  Description of Artificial Sequence: Synthetic peptide
  Seed: PVLPSPACQLVLHQILKG (PMEL_HUMAN)
  Core: LVLHQILKG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQXVLXQXLKX

SEQ ID NO: 334401 - protein, 19 aa, Artificial Sequence
  Description of Artificial Sequence: Synthetic peptide
  Seed: PVLPSPACQLVLHQILKGG (PMEL_HUMAN)
  Core: CQLVLHQIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPAXQLXLXQIXKGG

SEQ ID NO: 334402 - protein, 19 aa, Artificial Sequence
  Description of Artificial Sequence: Synthetic peptide
  Seed: PVLPSPACQLVLHQILKGG (PMEL_HUMAN)
  Core: LVLHQILKG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQXVLXQXLKXG

SEQ ID NO: 334403 - protein, 20 aa, Artificial Sequence
  Description of Artificial Sequence: Synthetic peptide
  Seed: PVLPSPACQLVLHQILKGGS (PMEL_HUMAN)
  Core: CQLVLHQIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPAXQLXLXQIXKGGS

SEQ ID NO: 334404 - protein, 20 aa, Artificial Sequence
  Description of Artificial Sequence: Synthetic peptide
  Seed: PVLPSPACQLVLHQILKGGS (PMEL_HUMAN)
  Core: LVLHQILKG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQXVLXQXLKXGS

SEQ ID NO: 334405 - protein, 21 aa, Artificial Sequence
  Description of Artificial Sequence: Synthetic peptide
  Seed: PVLPSPACQLVLHQILKGGSG (PMEL_HUMAN)
  Core: LVLHQILKG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQXVLXQXLKXGSG

SEQ ID NO: 334406 - protein, 21 aa, Artificial Sequence
  Description of Artificial Sequence: Synthetic peptide
  Seed: PVLPSPACQLVLHQILKGGSG (PMEL_HUMAN)
  Core: LHQILKGGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQLVXHQXLXGGXG

SEQ ID NO: 334407 - protein, 22 aa, Artificial Sequence
  Description of Artificial Sequence: Synthetic peptide
  Seed: PVLPSPACQLVLHQILKGGSGT (PMEL_HUMAN)
  Core: LVLHQILKG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQXVLXQXLKXGSGT

SEQ ID NO: 334408 - protein, 22 aa, Artificial Sequence
  Description of Artificial Sequence: Synthetic peptide
  Seed: PVLPSPACQLVLHQILKGGSGT (PMEL_HUMAN)
  Core: LHQILKGGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQLVXHQXLXGGXGT

SEQ ID NO: 334409 - protein, 23 aa, Artificial Sequence
  Description of Artificial Sequence: Synthetic peptide
  Seed: PVLPSPACQLVLHQILKGGSGTY (PMEL_HUMAN)
  Core: LVLHQILKG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQXVLXQXLKXGSGTY

SEQ ID NO: 334410 - protein, 23 aa, Artificial Sequence
  Description of Artificial Sequence: Synthetic peptide
  Seed: PVLPSPACQLVLHQILKGGSGTY (PMEL_HUMAN)
  Core: LHQILKGGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQLVXHQXLXGGXGTY

SEQ ID NO: 334411 - protein, 24 aa, Artificial Sequence
  Description of Artificial Sequence: Synthetic peptide
  Seed: PVLPSPACQLVLHQILKGGSGTYC (PMEL_HUMAN)
  Core: LVLHQILKG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQXVLXQXLKXGSGTYC

SEQ ID NO: 334412 - protein, 24 aa, Artificial Sequence
  Description of Artificial Sequence: Synthetic peptide
  Seed: PVLPSPACQLVLHQILKGGSGTYC (PMEL_HUMAN)
  Core: LHQILKGGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQLVXHQXLXGGXGTYC

SEQ ID NO: 334413 - protein, 25 aa, Artificial Sequence
  Description of Artificial Sequence: Synthetic peptide
  Seed: PVLPSPACQLVLHQILKGGSGTYCL (PMEL_HUMAN)
  Core: LVLHQILKG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQXVLXQXLKXGSGTYCL

SEQ ID NO: 334414 - protein, 25 aa, Artificial Sequence
  Description of Artificial Sequence: Synthetic peptide
  Seed: PVLPSPACQLVLHQILKGGSGTYCL (PMEL_HUMAN)
  Core: LHQILKGGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
PVLPSPACQLVXHQXLXGGXGTYCL

SEQ ID NO: 334415 - protein, 15 aa, Artificial Sequence
  Description of Artificial Sequence: Synthetic peptide
  Seed: PVQMPTAESTGMTPE (PMEL_HUMAN)
  Core: PTAESTGMT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVQMXTAXSXGMXPE

SEQ ID NO: 334416 - protein, 20 aa, Artificial Sequence
  Description of Artificial Sequence: Synthetic peptide
  Seed: PVQMPTAESTGMTPEKVPVS (PMEL_HUMAN)
  Core: STGMTPEKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
PVQMPTAEXTGXTXEKXPVS

SEQ ID NO: 334417 - protein, 13 aa, Artificial Sequence
  Description of Artificial Sequence: Synthetic peptide
  Seed: PVSEVMGTTLAEM (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEX

SEQ ID NO: 334418 - protein, 14 aa, Artificial Sequence
  Description of Artificial Sequence: Synthetic peptide
  Seed: PVSEVMGTTLAEMS (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXS

SEQ ID NO: 334419 - protein, 15 aa, Artificial Sequence
  Description of Artificial Sequence: Synthetic peptide
  Seed: PVSEVMGTTLAEMST (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXST

SEQ ID NO: 334420 - protein, 15 aa, Artificial Sequence
  Description of Artificial Sequence: Synthetic peptide
  Seed: PVSEVMGTTLAEMST (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXT

SEQ ID NO: 334421 - protein, 16 aa, Artificial Sequence
  Description of Artificial Sequence: Synthetic peptide
  Seed: PVSEVMGTTLAEMSTP (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTP

SEQ ID NO: 334422 - protein, 16 aa, Artificial Sequence
  Description of Artificial Sequence: Synthetic peptide
  Seed: PVSEVMGTTLAEMSTP (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTP

SEQ ID NO: 334423 - protein, 17 aa, Artificial Sequence
  Description of Artificial Sequence: Synthetic peptide
  Seed: PVSEVMGTTLAEMSTPE (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTPE

SEQ ID NO: 334424 - protein, 17 aa, Artificial Sequence
  Description of Artificial Sequence: Synthetic peptide
  Seed: PVSEVMGTTLAEMSTPE (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTPE

SEQ ID NO: 334425 - protein, 18 aa, Artificial Sequence
  Description of Artificial Sequence: Synthetic peptide
  Seed: PVSEVMGTTLAEMSTPEA (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTPEA

SEQ ID NO: 334426 - protein, 18 aa, Artificial Sequence
  Description of Artificial Sequence: Synthetic peptide
  Seed: PVSEVMGTTLAEMSTPEA (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTPEA

SEQ ID NO: 334427 - protein, 19 aa, Artificial Sequence
  Description of Artificial Sequence: Synthetic peptide
  Seed: PVSEVMGTTLAEMSTPEAT (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTPEAT

SEQ ID NO: 334428 - protein, 19 aa, Artificial Sequence
  Description of Artificial Sequence: Synthetic peptide
  Seed: PVSEVMGTTLAEMSTPEAT (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTPEAT

SEQ ID NO: 334429 - protein, 19 aa, Artificial Sequence
  Description of Artificial Sequence: Synthetic peptide
  Seed: PVSEVMGTTLAEMSTPEAT (PMEL_HUMAN)
  Core: LAEMSTPEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTXAEXSXPEXT

SEQ ID NO: 334430 - protein, 20 aa, Artificial Sequence
  Description of Artificial Sequence: Synthetic peptide
  Seed: PVSEVMGTTLAEMSTPEATG (PMEL_HUMAN)
  Core: EVMGTTLAE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PVSXVMXTXLAXMSTPEATG

SEQ ID NO: 334431 - protein, 20 aa, Artificial Sequence
  Description of Artificial Sequence: Synthetic peptide
  Seed: PVSEVMGTTLAEMSTPEATG (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTPEATG

SEQ ID NO: 334432 - protein, 20 aa, Artificial Sequence
  Description of Artificial Sequence: Synthetic peptide
  Seed: PVSEVMGTTLAEMSTPEATG (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTPEATG

SEQ ID NO: 334433 - protein, 20 aa, Artificial Sequence
  Description of Artificial Sequence: Synthetic peptide
  Seed: PVSEVMGTTLAEMSTPEATG (PMEL_HUMAN)
  Core: LAEMSTPEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTXAEXSXPEXTG

SEQ ID NO: 334434 - protein, 20 aa, Artificial Sequence
  Description of Artificial Sequence: Synthetic peptide
  Seed: PVSEVMGTTLAEMSTPEATG (PMEL_HUMAN)
  Core: AEMSTPEAT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTLXEMXTXEAXG

SEQ ID NO: 334435 - protein, 21 aa, Artificial Sequence
  Description of Artificial Sequence: Synthetic peptide
  Seed: PVSEVMGTTLAEMSTPEATGM (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTPEATGM

SEQ ID NO: 334436 - protein, 21 aa, Artificial Sequence
  Description of Artificial Sequence: Synthetic peptide
  Seed: PVSEVMGTTLAEMSTPEATGM (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTPEATGM

SEQ ID NO: 334437 - protein, 21 aa, Artificial Sequence
  Description of Artificial Sequence: Synthetic peptide
  Seed: PVSEVMGTTLAEMSTPEATGM (PMEL_HUMAN)
  Core: LAEMSTPEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTXAEXSXPEXTGM

SEQ ID NO: 334438 - protein, 22 aa, Artificial Sequence
  Description of Artificial Sequence: Synthetic peptide
  Seed: PVSEVMGTTLAEMSTPEATGMT (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTPEATGMT

SEQ ID NO: 334439 - protein, 22 aa, Artificial Sequence
  Description of Artificial Sequence: Synthetic peptide
  Seed: PVSEVMGTTLAEMSTPEATGMT (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTPEATGMT

SEQ ID NO: 334440 - protein, 22 aa, Artificial Sequence
  Description of Artificial Sequence: Synthetic peptide
  Seed: PVSEVMGTTLAEMSTPEATGMT (PMEL_HUMAN)
  Core: LAEMSTPEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTXAEXSXPEXTGMT

SEQ ID NO: 334441 - protein, 22 aa, Artificial Sequence
  Description of Artificial Sequence: Synthetic peptide
  Seed: PVSEVMGTTLAEMSTPEATGMT (PMEL_HUMAN)
  Core: AEMSTPEAT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTLXEMXTXEAXGMT

SEQ ID NO: 334442 - protein, 23 aa, Artificial Sequence
  Description of Artificial Sequence: Synthetic peptide
  Seed: PVSEVMGTTLAEMSTPEATGMTP (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTPEATGMTP

SEQ ID NO: 334443 - protein, 23 aa, Artificial Sequence
  Description of Artificial Sequence: Synthetic peptide
  Seed: PVSEVMGTTLAEMSTPEATGMTP (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTPEATGMTP

SEQ ID NO: 334444 - protein, 23 aa, Artificial Sequence
  Description of Artificial Sequence: Synthetic peptide
  Seed: PVSEVMGTTLAEMSTPEATGMTP (PMEL_HUMAN)
  Core: LAEMSTPEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTXAEXSXPEXTGMTP

SEQ ID NO: 334445 - protein, 23 aa, Artificial Sequence
  Description of Artificial Sequence: Synthetic peptide
  Seed: PVSEVMGTTLAEMSTPEATGMTP (PMEL_HUMAN)
  Core: AEMSTPEAT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTLXEMXTXEAXGMTP

SEQ ID NO: 334446 - protein, 24 aa, Artificial Sequence
  Description of Artificial Sequence: Synthetic peptide
  Seed: PVSEVMGTTLAEMSTPEATGMTPA (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTPEATGMTPA

SEQ ID NO: 334447 - protein, 24 aa, Artificial Sequence
  Description of Artificial Sequence: Synthetic peptide
  Seed: PVSEVMGTTLAEMSTPEATGMTPA (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTPEATGMTPA

SEQ ID NO: 334448 - protein, 24 aa, Artificial Sequence
  Description of Artificial Sequence: Synthetic peptide
  Seed: PVSEVMGTTLAEMSTPEATGMTPA (PMEL_HUMAN)
  Core: LAEMSTPEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTXAEXSXPEXTGMTPA

SEQ ID NO: 334449 - protein, 24 aa, Artificial Sequence
  Description of Artificial Sequence: Synthetic peptide
  Seed: PVSEVMGTTLAEMSTPEATGMTPA (PMEL_HUMAN)
  Core: AEMSTPEAT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTLXEMXTXEAXGMTPA

SEQ ID NO: 334450 - protein, 25 aa, Artificial Sequence
  Description of Artificial Sequence: Synthetic peptide
  Seed: PVSEVMGTTLAEMSTPEATGMTPAE (PMEL_HUMAN)
  Core: VMGTTLAEM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSEXMGXTXAEXSTPEATGMTPAE

SEQ ID NO: 334451 - protein, 25 aa, Artificial Sequence
  Description of Artificial Sequence: Synthetic peptide
  Seed: PVSEVMGTTLAEMSTPEATGMTPAE (PMEL_HUMAN)
  Core: MGTTLAEMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVXGTXLXEMXTPEATGMTPAE

SEQ ID NO: 334452 - protein, 25 aa, Artificial Sequence
  Description of Artificial Sequence: Synthetic peptide
  Seed: PVSEVMGTTLAEMSTPEATGMTPAE (PMEL_HUMAN)
  Core: LAEMSTPEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTXAEXSXPEXTGMTPAE

SEQ ID NO: 334453 - protein, 25 aa, Artificial Sequence
  Description of Artificial Sequence: Synthetic peptide
  Seed: PVSEVMGTTLAEMSTPEATGMTPAE (PMEL_HUMAN)
  Core: AEMSTPEAT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PVSEVMGTTLXEMXTXEAXGMTPAE

SEQ ID NO: 334454 - protein, 13 aa, Artificial Sequence
  Description of Artificial Sequence: Synthetic peptide
  Seed: PVSGLSIGTGRAM (PMEL_HUMAN)
  Core: LSIGTGRAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSGXSIXTXRAX

SEQ ID NO: 334455 - protein, 14 aa, Artificial Sequence
  Description of Artificial Sequence: Synthetic peptide
  Seed: PVSGLSIGTGRAML (PMEL_HUMAN)
  Core: VSGLSIGTG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSGXSXGTXRAML

SEQ ID NO: 334456 - protein, 14 aa, Artificial Sequence
  Description of Artificial Sequence: Synthetic peptide
  Seed: PVSGLSIGTGRAML (PMEL_HUMAN)
  Core: LSIGTGRAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSGXSIXTXRAXL

SEQ ID NO: 334457 - protein, 15 aa, Artificial Sequence
  Description of Artificial Sequence: Synthetic peptide
  Seed: PVSGLSIGTGRAMLG (PMEL_HUMAN)
  Core: VSGLSIGTG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXSGXSXGTXRAMLG

SEQ ID NO: 334458 - protein, 15 aa, Artificial Sequence
  Description of Artificial Sequence: Synthetic peptide
  Seed: PVSGLSIGTGRAMLG (PMEL_HUMAN)
  Core: LSIGTGRAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSGXSIXTXRAXLG

SEQ ID NO: 334459 - protein, 15 aa, Artificial Sequence
  Description of Artificial Sequence: Synthetic peptide
  Seed: PVSGLSIGTGRAMLG (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLX

SEQ ID NO: 334460 - protein, 16 aa, Artificial Sequence
  Description of Artificial Sequence: Synthetic peptide
  Seed: PVSGLSIGTGRAMLGT (PMEL_HUMAN)
  Core: LSIGTGRAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSGXSIXTXRAXLGT

SEQ ID NO: 334461 - protein, 16 aa, Artificial Sequence
  Description of Artificial Sequence: Synthetic peptide
  Seed: PVSGLSIGTGRAMLGT (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXT

SEQ ID NO: 334462 - protein, 17 aa, Artificial Sequence
  Description of Artificial Sequence: Synthetic peptide
  Seed: PVSGLSIGTGRAMLGTH (PMEL_HUMAN)
  Core: LSIGTGRAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSGXSIXTXRAXLGTH

SEQ ID NO: 334463 - protein, 17 aa, Artificial Sequence
  Description of Artificial Sequence: Synthetic peptide
  Seed: PVSGLSIGTGRAMLGTH (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXTH

SEQ ID NO: 334464 - protein, 18 aa, Artificial Sequence
  Description of Artificial Sequence: Synthetic peptide
  Seed: PVSGLSIGTGRAMLGTHT (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXTHT

SEQ ID NO: 334465 - protein, 19 aa, Artificial Sequence
  Description of Artificial Sequence: Synthetic peptide
  Seed: PVSGLSIGTGRAMLGTHTM (PMEL_HUMAN)
  Core: LSIGTGRAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSGXSIXTXRAXLGTHTM

SEQ ID NO: 334466 - protein, 19 aa, Artificial Sequence
  Description of Artificial Sequence: Synthetic peptide
  Seed: PVSGLSIGTGRAMLGTHTM (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXTHTM

SEQ ID NO: 334467 - protein, 20 aa, Artificial Sequence
  Description of Artificial Sequence: Synthetic peptide
  Seed: PVSGLSIGTGRAMLGTHTME (PMEL_HUMAN)
  Core: LSIGTGRAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSGXSIXTXRAXLGTHTME

SEQ ID NO: 334468 - protein, 20 aa, Artificial Sequence
  Description of Artificial Sequence: Synthetic peptide
  Seed: PVSGLSIGTGRAMLGTHTME (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXTHTME

SEQ ID NO: 334469 - protein, 21 aa, Artificial Sequence
  Description of Artificial Sequence: Synthetic peptide
  Seed: PVSGLSIGTGRAMLGTHTMEV (PMEL_HUMAN)
  Core: LSIGTGRAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSGXSIXTXRAXLGTHTMEV

SEQ ID NO: 334470 - protein, 21 aa, Artificial Sequence
  Description of Artificial Sequence: Synthetic peptide
  Seed: PVSGLSIGTGRAMLGTHTMEV (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXTHTMEV

SEQ ID NO: 334471 - protein, 21 aa, Artificial Sequence
  Description of Artificial Sequence: Synthetic peptide
  Seed: PVSGLSIGTGRAMLGTHTMEV (PMEL_HUMAN)
  Core: MLGTHTMEV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGRAXLGXHXMEX

SEQ ID NO: 334472 - protein, 22 aa, Artificial Sequence
  Description of Artificial Sequence: Synthetic peptide
  Seed: PVSGLSIGTGRAMLGTHTMEVT (PMEL_HUMAN)
  Core: LSIGTGRAM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
PVSGXSIXTXRAXLGTHTMEVT

SEQ ID NO: 334473 - protein, 22 aa, Artificial Sequence
  Description of Artificial Sequence: Synthetic peptide
  Seed: PVSGLSIGTGRAMLGTHTMEVT (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXTHTMEVT

SEQ ID NO: 334474 - protein, 22 aa, Artificial Sequence
  Description of Artificial Sequence: Synthetic peptide
  Seed: PVSGLSIGTGRAMLGTHTMEVT (PMEL_HUMAN)
  Core: RAMLGTHTM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGXAMXGXHTXEVT

SEQ ID NO: 334475 - protein, 22 aa, Artificial Sequence
  Description of Artificial Sequence: Synthetic peptide
  Seed: PVSGLSIGTGRAMLGTHTMEVT (PMEL_HUMAN)
  Core: MLGTHTMEV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGRAXLGXHXMEXT

SEQ ID NO: 334476 - protein, 23 aa, Artificial Sequence
  Description of Artificial Sequence: Synthetic peptide
  Seed: PVSGLSIGTGRAMLGTHTMEVTV (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXTHTMEVTV

SEQ ID NO: 334477 - protein, 23 aa, Artificial Sequence
  Description of Artificial Sequence: Synthetic peptide
  Seed: PVSGLSIGTGRAMLGTHTMEVTV (PMEL_HUMAN)
  Core: RAMLGTHTM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGXAMXGXHTXEVTV

SEQ ID NO: 334478 - protein, 23 aa, Artificial Sequence
  Description of Artificial Sequence: Synthetic peptide
  Seed: PVSGLSIGTGRAMLGTHTMEVTV (PMEL_HUMAN)
  Core: MLGTHTMEV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGRAXLGXHXMEXTV

SEQ ID NO: 334479 - protein, 24 aa, Artificial Sequence
  Description of Artificial Sequence: Synthetic peptide
  Seed: PVSGLSIGTGRAMLGTHTMEVTVY (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXTHTMEVTVY

SEQ ID NO: 334480 - protein, 24 aa, Artificial Sequence
  Description of Artificial Sequence: Synthetic peptide
  Seed: PVSGLSIGTGRAMLGTHTMEVTVY (PMEL_HUMAN)
  Core: RAMLGTHTM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGXAMXGXHTXEVTVY

SEQ ID NO: 334481 - protein, 24 aa, Artificial Sequence
  Description of Artificial Sequence: Synthetic peptide
  Seed: PVSGLSIGTGRAMLGTHTMEVTVY (PMEL_HUMAN)
  Core: MLGTHTMEV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGRAXLGXHXMEXTVY

SEQ ID NO: 334482 - protein, 25 aa, Artificial Sequence
  Description of Artificial Sequence: Synthetic peptide
  Seed: PVSGLSIGTGRAMLGTHTMEVTVYH (PMEL_HUMAN)
  Core: IGTGRAMLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSXGTXRXMLXTHTMEVTVYH

SEQ ID NO: 334483 - protein, 25 aa, Artificial Sequence
  Description of Artificial Sequence: Synthetic peptide
  Seed: PVSGLSIGTGRAMLGTHTMEVTVYH (PMEL_HUMAN)
  Core: RAMLGTHTM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGXAMXGXHTXEVTVYH

SEQ ID NO: 334484 - protein, 25 aa, Artificial Sequence
  Description of Artificial Sequence: Synthetic peptide
  Seed: PVSGLSIGTGRAMLGTHTMEVTVYH (PMEL_HUMAN)
  Core: MLGTHTMEV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGRAXLGXHXMEXTVYH

SEQ ID NO: 334485 - protein, 25 aa, Artificial Sequence
  Description of Artificial Sequence: Synthetic peptide
  Seed: PVSGLSIGTGRAMLGTHTMEVTVYH (PMEL_HUMAN)
  Core: LGTHTMEVT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PVSGLSIGTGRAMXGTXTXEVXVYH

SEQ ID NO: 334486 - protein, 13 aa, Artificial Sequence
  Description of Artificial Sequence: Synthetic peptide
  Seed: PVTAQVVLQAAIP (PMEL_HUMAN)
  Core: VTAQVVLQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXTAXVXLQXAIP

SEQ ID NO: 334487 - protein, 13 aa, Artificial Sequence
  Description of Artificial Sequence: Synthetic peptide
  Seed: PVTAQVVLQAAIP (PMEL_HUMAN)
  Core: TAQVVLQAA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PVXAQXVXQAXIP

SEQ ID NO: 334488 - protein, 14 aa, Artificial Sequence
  Description of Artificial Sequence: Synthetic peptide
  Seed: PVTAQVVLQAAIPL (PMEL_HUMAN)
  Core: VTAQVVLQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXTAXVXLQXAIPL

SEQ ID NO: 334489 - protein, 14 aa, Artificial Sequence
  Description of Artificial Sequence: Synthetic peptide
  Seed: PVTAQVVLQAAIPL (PMEL_HUMAN)
  Core: TAQVVLQAA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PVXAQXVXQAXIPL

SEQ ID NO: 334490 - protein, 14 aa, Artificial Sequence
  Description of Artificial Sequence: Synthetic peptide
  Seed: PVTAQVVLQAAIPL (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPX

SEQ ID NO: 334491 - protein, 15 aa, Artificial Sequence
  Description of Artificial Sequence: Synthetic peptide
  Seed: PVTAQVVLQAAIPLT (PMEL_HUMAN)
  Core: VTAQVVLQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
PXTAXVXLQXAIPLT

SEQ ID NO: 334492 - protein, 15 aa, Artificial Sequence
  Description of Artificial Sequence: Synthetic peptide
  Seed: PVTAQVVLQAAIPLT (PMEL_HUMAN)
  Core: TAQVVLQAA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PVXAQXVXQAXIPLT

SEQ ID NO: 334493 - protein, 15 aa, Artificial Sequence
  Description of Artificial Sequence: Synthetic peptide
  Seed: PVTAQVVLQAAIPLT (PMEL_HUMAN)
  Core: AQVVLQAAI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
PVTXQVXLXAAXPLT

SEQ ID NO: 334494 - protein, 15 aa, Artificial Sequence
  Description of Artificial Sequence: Synthetic peptide
  Seed: PVTAQVVLQAAIPLT (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXT

SEQ ID NO: 334495 - protein, 15 aa, Artificial Sequence
  Description of Artificial Sequence: Synthetic peptide
  Seed: PVTAQVVLQAAIPLT (PMEL_HUMAN)
  Core: VLQAAIPLT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVXLQXAXPLX

SEQ ID NO: 334496 - protein, 16 aa, Artificial Sequence
  Description of Artificial Sequence: Synthetic peptide
  Seed: PVTAQVVLQAAIPLTS (PMEL_HUMAN)
  Core: TAQVVLQAA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PVXAQXVXQAXIPLTS

SEQ ID NO: 334497 - protein, 16 aa, Artificial Sequence
  Description of Artificial Sequence: Synthetic peptide
  Seed: PVTAQVVLQAAIPLTS (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTS

SEQ ID NO: 334498 - protein, 16 aa, Artificial Sequence
  Description of Artificial Sequence: Synthetic peptide
  Seed: PVTAQVVLQAAIPLTS (PMEL_HUMAN)
  Core: VLQAAIPLT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVXLQXAXPLXS

SEQ ID NO: 334499 - protein, 16 aa, Artificial Sequence
  Description of Artificial Sequence: Synthetic peptide
  Seed: PVTAQVVLQAAIPLTS (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTX

SEQ ID NO: 334500 - protein, 17 aa, Artificial Sequence
  Description of Artificial Sequence: Synthetic peptide
  Seed: PVTAQVVLQAAIPLTSC (PMEL_HUMAN)
  Core: TAQVVLQAA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
PVXAQXVXQAXIPLTSC

SEQ ID NO: 334501 - protein, 17 aa, Artificial Sequence
  Description of Artificial Sequence: Synthetic peptide
  Seed: PVTAQVVLQAAIPLTSC (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTSC

SEQ ID NO: 334502 - protein, 17 aa, Artificial Sequence
  Description of Artificial Sequence: Synthetic peptide
  Seed: PVTAQVVLQAAIPLTSC (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTXC

SEQ ID NO: 334503 - protein, 18 aa, Artificial Sequence
  Description of Artificial Sequence: Synthetic peptide
  Seed: PVTAQVVLQAAIPLTSCG (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTSCG

SEQ ID NO: 334504 - protein, 18 aa, Artificial Sequence
  Description of Artificial Sequence: Synthetic peptide
  Seed: PVTAQVVLQAAIPLTSCG (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTXCG

SEQ ID NO: 334505 - protein, 19 aa, Artificial Sequence
  Description of Artificial Sequence: Synthetic peptide
  Seed: PVTAQVVLQAAIPLTSCGS (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTSCGS

SEQ ID NO: 334506 - protein, 19 aa, Artificial Sequence
  Description of Artificial Sequence: Synthetic peptide
  Seed: PVTAQVVLQAAIPLTSCGS (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTXCGS

SEQ ID NO: 334507 - protein, 20 aa, Artificial Sequence
  Description of Artificial Sequence: Synthetic peptide
  Seed: PVTAQVVLQAAIPLTSCGSS (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTSCGSS

SEQ ID NO: 334508 - protein, 20 aa, Artificial Sequence
  Description of Artificial Sequence: Synthetic peptide
  Seed: PVTAQVVLQAAIPLTSCGSS (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTXCGSS

SEQ ID NO: 334509 - protein, 21 aa, Artificial Sequence
  Description of Artificial Sequence: Synthetic peptide
  Seed: PVTAQVVLQAAIPLTSCGSSP (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTSCGSSP

SEQ ID NO: 334510 - protein, 21 aa, Artificial Sequence
  Description of Artificial Sequence: Synthetic peptide
  Seed: PVTAQVVLQAAIPLTSCGSSP (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTXCGSSP

SEQ ID NO: 334511 - protein, 22 aa, Artificial Sequence
  Description of Artificial Sequence: Synthetic peptide
  Seed: PVTAQVVLQAAIPLTSCGSSPV (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTSCGSSPV

SEQ ID NO: 334512 - protein, 22 aa, Artificial Sequence
  Description of Artificial Sequence: Synthetic peptide
  Seed: PVTAQVVLQAAIPLTSCGSSPV (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTXCGSSPV

SEQ ID NO: 334513 - protein, 23 aa, Artificial Sequence
  Description of Artificial Sequence: Synthetic peptide
  Seed: PVTAQVVLQAAIPLTSCGSSPVP (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTSCGSSPVP

SEQ ID NO: 334514 - protein, 23 aa, Artificial Sequence
  Description of Artificial Sequence: Synthetic peptide
  Seed: PVTAQVVLQAAIPLTSCGSSPVP (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTXCGSSPVP

SEQ ID NO: 334515 - protein, 24 aa, Artificial Sequence
  Description of Artificial Sequence: Synthetic peptide
  Seed: PVTAQVVLQAAIPLTSCGSSPVPG (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTSCGSSPVPG

SEQ ID NO: 334516 - protein, 24 aa, Artificial Sequence
  Description of Artificial Sequence: Synthetic peptide
  Seed: PVTAQVVLQAAIPLTSCGSSPVPG (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTXCGSSPVPG

SEQ ID NO: 334517 - protein, 24 aa, Artificial Sequence
  Description of Artificial Sequence: Synthetic peptide
  Seed: PVTAQVVLQAAIPLTSCGSSPVPG (PMEL_HUMAN)
  Core: LTSCGSSPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVLQAAIPXTSXGXSPXPG

SEQ ID NO: 334518 - protein, 25 aa, Artificial Sequence
  Description of Artificial Sequence: Synthetic peptide
  Seed: PVTAQVVLQAAIPLTSCGSSPVPGT (PMEL_HUMAN)
  Core: VVLQAAIPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQXVLXAXIPXTSCGSSPVPGT

SEQ ID NO: 334519 - protein, 25 aa, Artificial Sequence
  Description of Artificial Sequence: Synthetic peptide
  Seed: PVTAQVVLQAAIPLTSCGSSPVPGT (PMEL_HUMAN)
  Core: LQAAIPLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVXQAXIXLTXCGSSPVPGT

SEQ ID NO: 334520 - protein, 25 aa, Artificial Sequence
  Description of Artificial Sequence: Synthetic peptide
  Seed: PVTAQVVLQAAIPLTSCGSSPVPGT (PMEL_HUMAN)
  Core: LTSCGSSPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
PVTAQVVLQAAIPXTSXGXSPXPGT

SEQ ID NO: 334521 - protein, 15 aa, Artificial Sequence
  Description of Artificial Sequence: Synthetic peptide
  Seed: QAAIPLTSCGSSPVP (PMEL_HUMAN)
  Core: LTSCGSSPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPXTSXGXSPXP

SEQ ID NO: 334522 - protein, 16 aa, Artificial Sequence
  Description of Artificial Sequence: Synthetic peptide
  Seed: QAAIPLTSCGSSPVPG (PMEL_HUMAN)
  Core: LTSCGSSPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPXTSXGXSPXPG

SEQ ID NO: 334523 - protein, 17 aa, Artificial Sequence
  Description of Artificial Sequence: Synthetic peptide
  Seed: QAAIPLTSCGSSPVPGT (PMEL_HUMAN)
  Core: LTSCGSSPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPXTSXGXSPXPGT

SEQ ID NO: 334524 - protein, 19 aa, Artificial Sequence
  Description of Artificial Sequence: Synthetic peptide
  Seed: QAAIPLTSCGSSPVPGTTD (PMEL_HUMAN)
  Core: SCGSSPVPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPLTXCGXSXVPXTTD

SEQ ID NO: 334525 - protein, 20 aa, Artificial Sequence
  Description of Artificial Sequence: Synthetic peptide
  Seed: QAAIPLTSCGSSPVPGTTDG (PMEL_HUMAN)
  Core: SCGSSPVPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPLTXCGXSXVPXTTDG

SEQ ID NO: 334526 - protein, 21 aa, Artificial Sequence
  Description of Artificial Sequence: Synthetic peptide
  Seed: QAAIPLTSCGSSPVPGTTDGH (PMEL_HUMAN)
  Core: SCGSSPVPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPLTXCGXSXVPXTTDGH

SEQ ID NO: 334527 - protein, 22 aa, Artificial Sequence
  Description of Artificial Sequence: Synthetic peptide
  Seed: QAAIPLTSCGSSPVPGTTDGHR (PMEL_HUMAN)
  Core: SCGSSPVPG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPLTXCGXSXVPXTTDGHR

SEQ ID NO: 334528 - protein, 23 aa, Artificial Sequence
  Description of Artificial Sequence: Synthetic peptide
  Seed: QAAIPLTSCGSSPVPGTTDGHRP (PMEL_HUMAN)
  Core: PVPGTTDGH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPLTSCGSSXVPXTXDGXRP

SEQ ID NO: 334529 - protein, 24 aa, Artificial Sequence
  Description of Artificial Sequence: Synthetic peptide
  Seed: QAAIPLTSCGSSPVPGTTDGHRPT (PMEL_HUMAN)
  Core: PVPGTTDGH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPLTSCGSSXVPXTXDGXRPT

SEQ ID NO: 334530 - protein, 25 aa, Artificial Sequence
  Description of Artificial Sequence: Synthetic peptide
  Seed: QAAIPLTSCGSSPVPGTTDGHRPTA (PMEL_HUMAN)
  Core: PVPGTTDGH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QAAIPLTSCGSSXVPXTXDGXRPTA

SEQ ID NO: 334531 - protein, 15 aa, Artificial Sequence
  Description of Artificial Sequence: Synthetic peptide
  Seed: QAPTAEPSGTTSVQV (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQX

SEQ ID NO: 334532 - protein, 16 aa, Artificial Sequence
  Description of Artificial Sequence: Synthetic peptide
  Seed: QAPTAEPSGTTSVQVP (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQXP

SEQ ID NO: 334533 - protein, 17 aa, Artificial Sequence
  Description of Artificial Sequence: Synthetic peptide
  Seed: QAPTAEPSGTTSVQVPT (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQXPT

SEQ ID NO: 334534 - protein, 19 aa, Artificial Sequence
  Description of Artificial Sequence: Synthetic peptide
  Seed: QAPTAEPSGTTSVQVPTTE (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQXPTTE

SEQ ID NO: 334535 - protein, 20 aa, Artificial Sequence
  Description of Artificial Sequence: Synthetic peptide
  Seed: QAPTAEPSGTTSVQVPTTEV (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQXPTTEV

SEQ ID NO: 334536 - protein, 20 aa, Artificial Sequence
  Description of Artificial Sequence: Synthetic peptide
  Seed: QAPTAEPSGTTSVQVPTTEV (PMEL_HUMAN)
  Core: TTSVQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEPSGXTSXQXPTXEV

SEQ ID NO: 334537 - protein, 21 aa, Artificial Sequence
  Description of Artificial Sequence: Synthetic peptide
  Seed: QAPTAEPSGTTSVQVPTTEVI (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQXPTTEVI

SEQ ID NO: 334538 - protein, 22 aa, Artificial Sequence
  Description of Artificial Sequence: Synthetic peptide
  Seed: QAPTAEPSGTTSVQVPTTEVIS (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQXPTTEVIS

SEQ ID NO: 334539 - protein, 23 aa, Artificial Sequence
  Description of Artificial Sequence: Synthetic peptide
  Seed: QAPTAEPSGTTSVQVPTTEVIST (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQXPTTEVIST

SEQ ID NO: 334540 - protein, 24 aa, Artificial Sequence
  Description of Artificial Sequence: Synthetic peptide
  Seed: QAPTAEPSGTTSVQVPTTEVISTA (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQXPTTEVISTA

SEQ ID NO: 334541 - protein, 24 aa, Artificial Sequence
  Description of Artificial Sequence: Synthetic peptide
  Seed: QAPTAEPSGTTSVQVPTTEVISTA (PMEL_HUMAN)
  Core: TTSVQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEPSGXTSXQXPTXEVISTA

SEQ ID NO: 334542 - protein, 25 aa, Artificial Sequence
  Description of Artificial Sequence: Synthetic peptide
  Seed: QAPTAEPSGTTSVQVPTTEVISTAP (PMEL_HUMAN)
  Core: PSGTTSVQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEXSGXTXVQXPTTEVISTAP

SEQ ID NO: 334543 - protein, 25 aa, Artificial Sequence
  Description of Artificial Sequence: Synthetic peptide
  Seed: QAPTAEPSGTTSVQVPTTEVISTAP (PMEL_HUMAN)
  Core: TTSVQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QAPTAEPSGXTSXQXPTXEVISTAP

SEQ ID NO: 334544 - protein, 19 aa, Artificial Sequence
  Description of Artificial Sequence: Synthetic peptide
  Seed: QDFSVPQLPHSSSHWLRLP (PMEL_HUMAN)
  Core: HSSSHWLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLPXSSXHXLRXP

SEQ ID NO: 334545 - protein, 20 aa, Artificial Sequence
  Description of Artificial Sequence: Synthetic peptide
  Seed: QDFSVPQLPHSSSHWLRLPR (PMEL_HUMAN)
  Core: LPHSSSHWL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQXPHXSXHWXRLPR

SEQ ID NO: 334546 - protein, 20 aa, Artificial Sequence
  Description of Artificial Sequence: Synthetic peptide
  Seed: QDFSVPQLPHSSSHWLRLPR (PMEL_HUMAN)
  Core: PHSSSHWLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLXHSXSXWLXLPR

SEQ ID NO: 334547 - protein, 20 aa, Artificial Sequence
  Description of Artificial Sequence: Synthetic peptide
  Seed: QDFSVPQLPHSSSHWLRLPR (PMEL_HUMAN)
  Core: HSSSHWLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLPXSSXHXLRXPR

SEQ ID NO: 334548 - protein, 21 aa, Artificial Sequence
  Description of Artificial Sequence: Synthetic peptide
  Seed: QDFSVPQLPHSSSHWLRLPRI (PMEL_HUMAN)
  Core: LPHSSSHWL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQXPHXSXHWXRLPRI

SEQ ID NO: 334549 - protein, 21 aa, Artificial Sequence
  Description of Artificial Sequence: Synthetic peptide
  Seed: QDFSVPQLPHSSSHWLRLPRI (PMEL_HUMAN)
  Core: PHSSSHWLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLXHSXSXWLXLPRI

SEQ ID NO: 334550 - protein, 21 aa, Artificial Sequence
  Description of Artificial Sequence: Synthetic peptide
  Seed: QDFSVPQLPHSSSHWLRLPRI (PMEL_HUMAN)
  Core: HSSSHWLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLPXSSXHXLRXPRI

SEQ ID NO: 334551 - protein, 22 aa, Artificial Sequence
  Description of Artificial Sequence: Synthetic peptide
  Seed: QDFSVPQLPHSSSHWLRLPRIF (PMEL_HUMAN)
  Core: LPHSSSHWL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQXPHXSXHWXRLPRIF

SEQ ID NO: 334552 - protein, 22 aa, Artificial Sequence
  Description of Artificial Sequence: Synthetic peptide
  Seed: QDFSVPQLPHSSSHWLRLPRIF (PMEL_HUMAN)
  Core: HSSSHWLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLPXSSXHXLRXPRIF

SEQ ID NO: 334553 - protein, 23 aa, Artificial Sequence
  Description of Artificial Sequence: Synthetic peptide
  Seed: QDFSVPQLPHSSSHWLRLPRIFC (PMEL_HUMAN)
  Core: FSVPQLPHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXSVXQXPHXSSHWLRLPRIFC

SEQ ID NO: 334554 - protein, 23 aa, Artificial Sequence
  Description of Artificial Sequence: Synthetic peptide
  Seed: QDFSVPQLPHSSSHWLRLPRIFC (PMEL_HUMAN)
  Core: LPHSSSHWL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQXPHXSXHWXRLPRIFC

SEQ ID NO: 334555 - protein, 23 aa, Artificial Sequence
  Description of Artificial Sequence: Synthetic peptide
  Seed: QDFSVPQLPHSSSHWLRLPRIFC (PMEL_HUMAN)
  Core: PHSSSHWLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLXHSXSXWLXLPRIFC

SEQ ID NO: 334556 - protein, 23 aa, Artificial Sequence
  Description of Artificial Sequence: Synthetic peptide
  Seed: QDFSVPQLPHSSSHWLRLPRIFC (PMEL_HUMAN)
  Core: HSSSHWLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLPXSSXHXLRXPRIFC

SEQ ID NO: 334557 - protein, 24 aa, Artificial Sequence
  Description of Artificial Sequence: Synthetic peptide
  Seed: QDFSVPQLPHSSSHWLRLPRIFCS (PMEL_HUMAN)
  Core: FSVPQLPHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXSVXQXPHXSSHWLRLPRIFCS

SEQ ID NO: 334558 - protein, 24 aa, Artificial Sequence
  Description of Artificial Sequence: Synthetic peptide
  Seed: QDFSVPQLPHSSSHWLRLPRIFCS (PMEL_HUMAN)
  Core: SVPQLPHSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QDFXVPXLXHSXSHWLRLPRIFCS

SEQ ID NO: 334559 - protein, 24 aa, Artificial Sequence
  Description of Artificial Sequence: Synthetic peptide
  Seed: QDFSVPQLPHSSSHWLRLPRIFCS (PMEL_HUMAN)
  Core: LPHSSSHWL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQXPHXSXHWXRLPRIFCS

SEQ ID NO: 334560 - protein, 24 aa, Artificial Sequence
  Description of Artificial Sequence: Synthetic peptide
  Seed: QDFSVPQLPHSSSHWLRLPRIFCS (PMEL_HUMAN)
  Core: PHSSSHWLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLXHSXSXWLXLPRIFCS

SEQ ID NO: 334561 - protein, 24 aa, Artificial Sequence
  Description of Artificial Sequence: Synthetic peptide
  Seed: QDFSVPQLPHSSSHWLRLPRIFCS (PMEL_HUMAN)
  Core: HSSSHWLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLPXSSXHXLRXPRIFCS

SEQ ID NO: 334562 - protein, 24 aa, Artificial Sequence
  Description of Artificial Sequence: Synthetic peptide
  Seed: QDFSVPQLPHSSSHWLRLPRIFCS (PMEL_HUMAN)
  Core: WLRLPRIFC
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLPHSSSHXLRXPXIFXS

SEQ ID NO: 334563 - protein, 25 aa, Artificial Sequence
  Description of Artificial Sequence: Synthetic peptide
  Seed: QDFSVPQLPHSSSHWLRLPRIFCSC (PMEL_HUMAN)
  Core: FSVPQLPHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXSVXQXPHXSSHWLRLPRIFCSC

SEQ ID NO: 334564 - protein, 25 aa, Artificial Sequence
  Description of Artificial Sequence: Synthetic peptide
  Seed: QDFSVPQLPHSSSHWLRLPRIFCSC (PMEL_HUMAN)
  Core: SVPQLPHSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QDFXVPXLXHSXSHWLRLPRIFCSC

SEQ ID NO: 334565 - protein, 25 aa, Artificial Sequence
  Description of Artificial Sequence: Synthetic peptide
  Seed: QDFSVPQLPHSSSHWLRLPRIFCSC (PMEL_HUMAN)
  Core: LPHSSSHWL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQXPHXSXHWXRLPRIFCSC

SEQ ID NO: 334566 - protein, 25 aa, Artificial Sequence
  Description of Artificial Sequence: Synthetic peptide
  Seed: QDFSVPQLPHSSSHWLRLPRIFCSC (PMEL_HUMAN)
  Core: PHSSSHWLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLXHSXSXWLXLPRIFCSC

SEQ ID NO: 334567 - protein, 25 aa, Artificial Sequence
  Description of Artificial Sequence: Synthetic peptide
  Seed: QDFSVPQLPHSSSHWLRLPRIFCSC (PMEL_HUMAN)
  Core: HSSSHWLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLPXSSXHXLRXPRIFCSC

SEQ ID NO: 334568 - protein, 25 aa, Artificial Sequence
  Description of Artificial Sequence: Synthetic peptide
  Seed: QDFSVPQLPHSSSHWLRLPRIFCSC (PMEL_HUMAN)
  Core: SHWLRLPRI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QDFSVPQLPHSSXHWXRXPRXFCSC

SEQ ID NO: 334569 - protein, 14 aa, Artificial Sequence
  Description of Artificial Sequence: Synthetic peptide
  Seed: QDWLGVSRQLRTKA (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKA

SEQ ID NO: 334570 - protein, 15 aa, Artificial Sequence
  Description of Artificial Sequence: Synthetic peptide
  Seed: QDWLGVSRQLRTKAW (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAW

SEQ ID NO: 334571 - protein, 15 aa, Artificial Sequence
  Description of Artificial Sequence: Synthetic peptide
  Seed: QDWLGVSRQLRTKAW (PMEL_HUMAN)
  Core: LGVSRQLRT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QDWXGVXRXLRXKAW

SEQ ID NO: 334572 - protein, 16 aa, Artificial Sequence
  Description of Artificial Sequence: Synthetic peptide
  Seed: QDWLGVSRQLRTKAWN (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWN

SEQ ID NO: 334573 - protein, 16 aa, Artificial Sequence
  Description of Artificial Sequence: Synthetic peptide
  Seed: QDWLGVSRQLRTKAWN (PMEL_HUMAN)
  Core: LGVSRQLRT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QDWXGVXRXLRXKAWN

SEQ ID NO: 334574 - protein, 16 aa, Artificial Sequence
  Description of Artificial Sequence: Synthetic peptide
  Seed: QDWLGVSRQLRTKAWN (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWN

SEQ ID NO: 334575 - protein, 17 aa, Artificial Sequence
  Description of Artificial Sequence: Synthetic peptide
  Seed: QDWLGVSRQLRTKAWNR (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWNR

SEQ ID NO: 334576 - protein, 17 aa, Artificial Sequence
  Description of Artificial Sequence: Synthetic peptide
  Seed: QDWLGVSRQLRTKAWNR (PMEL_HUMAN)
  Core: LGVSRQLRT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QDWXGVXRXLRXKAWNR

SEQ ID NO: 334577 - protein, 17 aa, Artificial Sequence
  Description of Artificial Sequence: Synthetic peptide
  Seed: QDWLGVSRQLRTKAWNR (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWNR

SEQ ID NO: 334578 - protein, 18 aa, Artificial Sequence
  Description of Artificial Sequence: Synthetic peptide
  Seed: QDWLGVSRQLRTKAWNRQ (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWNRQ

SEQ ID NO: 334579 - protein, 18 aa, Artificial Sequence
  Description of Artificial Sequence: Synthetic peptide
  Seed: QDWLGVSRQLRTKAWNRQ (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWNRQ

SEQ ID NO: 334580 - protein, 19 aa, Artificial Sequence
  Description of Artificial Sequence: Synthetic peptide
  Seed: QDWLGVSRQLRTKAWNRQL (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWNRQL

SEQ ID NO: 334581 - protein, 19 aa, Artificial Sequence
  Description of Artificial Sequence: Synthetic peptide
  Seed: QDWLGVSRQLRTKAWNRQL (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWNRQL

SEQ ID NO: 334582 - protein, 19 aa, Artificial Sequence
  Description of Artificial Sequence: Synthetic peptide
  Seed: QDWLGVSRQLRTKAWNRQL (PMEL_HUMAN)
  Core: LRTKAWNRQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQXRTXAXNRXL

SEQ ID NO: 334583 - protein, 20 aa, Artificial Sequence
  Description of Artificial Sequence: Synthetic peptide
  Seed: QDWLGVSRQLRTKAWNRQLY (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWNRQLY

SEQ ID NO: 334584 - protein, 20 aa, Artificial Sequence
  Description of Artificial Sequence: Synthetic peptide
  Seed: QDWLGVSRQLRTKAWNRQLY (PMEL_HUMAN)
  Core: LGVSRQLRT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QDWXGVXRXLRXKAWNRQLY

SEQ ID NO: 334585 - protein, 20 aa, Artificial Sequence
  Description of Artificial Sequence: Synthetic peptide
  Seed: QDWLGVSRQLRTKAWNRQLY (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWNRQLY

SEQ ID NO: 334586 - protein, 20 aa, Artificial Sequence
  Description of Artificial Sequence: Synthetic peptide
  Seed: QDWLGVSRQLRTKAWNRQLY (PMEL_HUMAN)
  Core: QLRTKAWNR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRXLRXKXWNXQLY

SEQ ID NO: 334587 - protein, 20 aa, Artificial Sequence
  Description of Artificial Sequence: Synthetic peptide
  Seed: QDWLGVSRQLRTKAWNRQLY (PMEL_HUMAN)
  Core: LRTKAWNRQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQXRTXAXNRXLY

SEQ ID NO: 334588 - protein, 21 aa, Artificial Sequence
  Description of Artificial Sequence: Synthetic peptide
  Seed: QDWLGVSRQLRTKAWNRQLYP (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWNRQLYP

SEQ ID NO: 334589 - protein, 21 aa, Artificial Sequence
  Description of Artificial Sequence: Synthetic peptide
  Seed: QDWLGVSRQLRTKAWNRQLYP (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWNRQLYP

SEQ ID NO: 334590 - protein, 21 aa, Artificial Sequence
  Description of Artificial Sequence: Synthetic peptide
  Seed: QDWLGVSRQLRTKAWNRQLYP (PMEL_HUMAN)
  Core: LRTKAWNRQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQXRTXAXNRXLYP

SEQ ID NO: 334591 - protein, 21 aa, Artificial Sequence
  Description of Artificial Sequence: Synthetic peptide
  Seed: QDWLGVSRQLRTKAWNRQLYP (PMEL_HUMAN)
  Core: TKAWNRQLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQLRXKAXNXQLXP

SEQ ID NO: 334592 - protein, 22 aa, Artificial Sequence
  Description of Artificial Sequence: Synthetic peptide
  Seed: QDWLGVSRQLRTKAWNRQLYPE (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWNRQLYPE

SEQ ID NO: 334593 - protein, 22 aa, Artificial Sequence
  Description of Artificial Sequence: Synthetic peptide
  Seed: QDWLGVSRQLRTKAWNRQLYPE (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWNRQLYPE

SEQ ID NO: 334594 - protein, 22 aa, Artificial Sequence
  Description of Artificial Sequence: Synthetic peptide
  Seed: QDWLGVSRQLRTKAWNRQLYPE (PMEL_HUMAN)
  Core: LRTKAWNRQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQXRTXAXNRXLYPE

SEQ ID NO: 334595 - protein, 22 aa, Artificial Sequence
  Description of Artificial Sequence: Synthetic peptide
  Seed: QDWLGVSRQLRTKAWNRQLYPE (PMEL_HUMAN)
  Core: TKAWNRQLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQLRXKAXNXQLXPE

SEQ ID NO: 334596 - protein, 23 aa, Artificial Sequence
  Description of Artificial Sequence: Synthetic peptide
  Seed: QDWLGVSRQLRTKAWNRQLYPEW (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWNRQLYPEW

SEQ ID NO: 334597 - protein, 23 aa, Artificial Sequence
  Description of Artificial Sequence: Synthetic peptide
  Seed: QDWLGVSRQLRTKAWNRQLYPEW (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWNRQLYPEW

SEQ ID NO: 334598 - protein, 23 aa, Artificial Sequence
  Description of Artificial Sequence: Synthetic peptide
  Seed: QDWLGVSRQLRTKAWNRQLYPEW (PMEL_HUMAN)
  Core: LRTKAWNRQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQXRTXAXNRXLYPEW

SEQ ID NO: 334599 - protein, 23 aa, Artificial Sequence
  Description of Artificial Sequence: Synthetic peptide
  Seed: QDWLGVSRQLRTKAWNRQLYPEW (PMEL_HUMAN)
  Core: TKAWNRQLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQLRXKAXNXQLXPEW

SEQ ID NO: 334600 - protein, 24 aa, Artificial Sequence
  Description of Artificial Sequence: Synthetic peptide
  Seed: QDWLGVSRQLRTKAWNRQLYPEWT (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWNRQLYPEWT

SEQ ID NO: 334601 - protein, 24 aa, Artificial Sequence
  Description of Artificial Sequence: Synthetic peptide
  Seed: QDWLGVSRQLRTKAWNRQLYPEWT (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWNRQLYPEWT

SEQ ID NO: 334602 - protein, 24 aa, Artificial Sequence
  Description of Artificial Sequence: Synthetic peptide
  Seed: QDWLGVSRQLRTKAWNRQLYPEWT (PMEL_HUMAN)
  Core: LRTKAWNRQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQXRTXAXNRXLYPEWT

SEQ ID NO: 334603 - protein, 24 aa, Artificial Sequence
  Description of Artificial Sequence: Synthetic peptide
  Seed: QDWLGVSRQLRTKAWNRQLYPEWT (PMEL_HUMAN)
  Core: TKAWNRQLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQLRXKAXNXQLXPEWT

SEQ ID NO: 334604 - protein, 25 aa, Artificial Sequence
  Description of Artificial Sequence: Synthetic peptide
  Seed: QDWLGVSRQLRTKAWNRQLYPEWTE (PMEL_HUMAN)
  Core: WLGVSRQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QDXLGXSXQLXTKAWNRQLYPEWTE

SEQ ID NO: 334605 - protein, 25 aa, Artificial Sequence
  Description of Artificial Sequence: Synthetic peptide
  Seed: QDWLGVSRQLRTKAWNRQLYPEWTE (PMEL_HUMAN)
  Core: VSRQLRTKA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGXSRXLXTKXWNRQLYPEWTE

SEQ ID NO: 334606 - protein, 25 aa, Artificial Sequence
  Description of Artificial Sequence: Synthetic peptide
  Seed: QDWLGVSRQLRTKAWNRQLYPEWTE (PMEL_HUMAN)
  Core: LRTKAWNRQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQXRTXAXNRXLYPEWTE

SEQ ID NO: 334607 - protein, 25 aa, Artificial Sequence
  Description of Artificial Sequence: Synthetic peptide
  Seed: QDWLGVSRQLRTKAWNRQLYPEWTE (PMEL_HUMAN)
  Core: TKAWNRQLY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QDWLGVSRQLRXKAXNXQLXPEWTE

SEQ ID NO: 334608 - protein, 14 aa, Artificial Sequence
  Description of Artificial Sequence: Synthetic peptide
  Seed: QEAGLGQVPLIVGI (PMEL_HUMAN)
  Core: AGLGQVPLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QEXGLXQXPLXVGI

SEQ ID NO: 334609 - protein, 15 aa, Artificial Sequence
  Description of Artificial Sequence: Synthetic peptide
  Seed: QEAGLGQVPLIVGIL (PMEL_HUMAN)
  Core: AGLGQVPLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QEXGLXQXPLXVGIL

SEQ ID NO: 334610 - protein, 15 aa, Artificial Sequence
  Description of Artificial Sequence: Synthetic peptide
  Seed: QEAGLGQVPLIVGIL (PMEL_HUMAN)
  Core: GLGQVPLIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QEAXLGXVXLIXGIL

SEQ ID NO: 334611 - protein, 15 aa, Artificial Sequence
  Description of Artificial Sequence: Synthetic peptide
  Seed: QEAGLGQVPLIVGIL (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXIL

SEQ ID NO: 334612 - protein, 16 aa, Artificial Sequence
  Description of Artificial Sequence: Synthetic peptide
  Seed: QEAGLGQVPLIVGILL (PMEL_HUMAN)
  Core: AGLGQVPLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QEXGLXQXPLXVGILL

SEQ ID NO: 334613 - protein, 16 aa, Artificial Sequence
  Description of Artificial Sequence: Synthetic peptide
  Seed: QEAGLGQVPLIVGILL (PMEL_HUMAN)
  Core: GLGQVPLIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QEAXLGXVXLIXGILL

SEQ ID NO: 334614 - protein, 16 aa, Artificial Sequence
  Description of Artificial Sequence: Synthetic peptide
  Seed: QEAGLGQVPLIVGILL (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILL

SEQ ID NO: 334615 - protein, 17 aa, Artificial Sequence
  Description of Artificial Sequence: Synthetic peptide
  Seed: QEAGLGQVPLIVGILLV (PMEL_HUMAN)
  Core: AGLGQVPLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QEXGLXQXPLXVGILLV

SEQ ID NO: 334616 - protein, 17 aa, Artificial Sequence
  Description of Artificial Sequence: Synthetic peptide
  Seed: QEAGLGQVPLIVGILLV (PMEL_HUMAN)
  Core: GLGQVPLIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QEAXLGXVXLIXGILLV

SEQ ID NO: 334617 - protein, 17 aa, Artificial Sequence
  Description of Artificial Sequence: Synthetic peptide
  Seed: QEAGLGQVPLIVGILLV (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILLV

SEQ ID NO: 334618 - protein, 18 aa, Artificial Sequence
  Description of Artificial Sequence: Synthetic peptide
  Seed: QEAGLGQVPLIVGILLVL (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILLVL

SEQ ID NO: 334619 - protein, 19 aa, Artificial Sequence
  Description of Artificial Sequence: Synthetic peptide
  Seed: QEAGLGQVPLIVGILLVLM (PMEL_HUMAN)
  Core: AGLGQVPLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QEXGLXQXPLXVGILLVLM

SEQ ID NO: 334620 - protein, 19 aa, Artificial Sequence
  Description of Artificial Sequence: Synthetic peptide
  Seed: QEAGLGQVPLIVGILLVLM (PMEL_HUMAN)
  Core: GLGQVPLIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QEAXLGXVXLIXGILLVLM

SEQ ID NO: 334621 - protein, 19 aa, Artificial Sequence
  Description of Artificial Sequence: Synthetic peptide
  Seed: QEAGLGQVPLIVGILLVLM (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILLVLM

SEQ ID NO: 334622 - protein, 19 aa, Artificial Sequence
  Description of Artificial Sequence: Synthetic peptide
  Seed: QEAGLGQVPLIVGILLVLM (PMEL_HUMAN)
  Core: LIVGILLVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPXIVXIXLVXM

SEQ ID NO: 334623 - protein, 20 aa, Artificial Sequence
  Description of Artificial Sequence: Synthetic peptide
  Seed: QEAGLGQVPLIVGILLVLMA (PMEL_HUMAN)
  Core: AGLGQVPLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QEXGLXQXPLXVGILLVLMA

SEQ ID NO: 334624 - protein, 20 aa, Artificial Sequence
  Description of Artificial Sequence: Synthetic peptide
  Seed: QEAGLGQVPLIVGILLVLMA (PMEL_HUMAN)
  Core: GLGQVPLIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QEAXLGXVXLIXGILLVLMA

SEQ ID NO: 334625 - protein, 20 aa, Artificial Sequence
  Description of Artificial Sequence: Synthetic peptide
  Seed: QEAGLGQVPLIVGILLVLMA (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILLVLMA

SEQ ID NO: 334626 - protein, 20 aa, Artificial Sequence
  Description of Artificial Sequence: Synthetic peptide
  Seed: QEAGLGQVPLIVGILLVLMA (PMEL_HUMAN)
  Core: LIVGILLVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPXIVXIXLVXMA

SEQ ID NO: 334627 - protein, 20 aa, Artificial Sequence
  Description of Artificial Sequence: Synthetic peptide
  Seed: QEAGLGQVPLIVGILLVLMA (PMEL_HUMAN)
  Core: IVGILLVLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLXVGXLXVLXA

SEQ ID NO: 334628 - protein, 21 aa, Artificial Sequence
  Description of Artificial Sequence: Synthetic peptide
  Seed: QEAGLGQVPLIVGILLVLMAV (PMEL_HUMAN)
  Core: GLGQVPLIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QEAXLGXVXLIXGILLVLMAV

SEQ ID NO: 334629 - protein, 21 aa, Artificial Sequence
  Description of Artificial Sequence: Synthetic peptide
  Seed: QEAGLGQVPLIVGILLVLMAV (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILLVLMAV

SEQ ID NO: 334630 - protein, 21 aa, Artificial Sequence
  Description of Artificial Sequence: Synthetic peptide
  Seed: QEAGLGQVPLIVGILLVLMAV (PMEL_HUMAN)
  Core: LIVGILLVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPXIVXIXLVXMAV

SEQ ID NO: 334631 - protein, 21 aa, Artificial Sequence
  Description of Artificial Sequence: Synthetic peptide
  Seed: QEAGLGQVPLIVGILLVLMAV (PMEL_HUMAN)
  Core: IVGILLVLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLXVGXLXVLXAV

SEQ ID NO: 334632 - protein, 22 aa, Artificial Sequence
  Description of Artificial Sequence: Synthetic peptide
  Seed: QEAGLGQVPLIVGILLVLMAVV (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILLVLMAVV

SEQ ID NO: 334633 - protein, 22 aa, Artificial Sequence
  Description of Artificial Sequence: Synthetic peptide
  Seed: QEAGLGQVPLIVGILLVLMAVV (PMEL_HUMAN)
  Core: LIVGILLVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPXIVXIXLVXMAVV

SEQ ID NO: 334634 - protein, 22 aa, Artificial Sequence
  Description of Artificial Sequence: Synthetic peptide
  Seed: QEAGLGQVPLIVGILLVLMAVV (PMEL_HUMAN)
  Core: IVGILLVLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLXVGXLXVLXAVV

SEQ ID NO: 334635 - protein, 23 aa, Artificial Sequence
  Description of Artificial Sequence: Synthetic peptide
  Seed: QEAGLGQVPLIVGILLVLMAVVL (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILLVLMAVVL

SEQ ID NO: 334636 - protein, 23 aa, Artificial Sequence
  Description of Artificial Sequence: Synthetic peptide
  Seed: QEAGLGQVPLIVGILLVLMAVVL (PMEL_HUMAN)
  Core: LIVGILLVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPXIVXIXLVXMAVVL

SEQ ID NO: 334637 - protein, 23 aa, Artificial Sequence
  Description of Artificial Sequence: Synthetic peptide
  Seed: QEAGLGQVPLIVGILLVLMAVVL (PMEL_HUMAN)
  Core: IVGILLVLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLXVGXLXVLXAVVL

SEQ ID NO: 334638 - protein, 24 aa, Artificial Sequence
  Description of Artificial Sequence: Synthetic peptide
  Seed: QEAGLGQVPLIVGILLVLMAVVLA (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILLVLMAVVLA

SEQ ID NO: 334639 - protein, 24 aa, Artificial Sequence
  Description of Artificial Sequence: Synthetic peptide
  Seed: QEAGLGQVPLIVGILLVLMAVVLA (PMEL_HUMAN)
  Core: LIVGILLVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPXIVXIXLVXMAVVLA

SEQ ID NO: 334640 - protein, 24 aa, Artificial Sequence
  Description of Artificial Sequence: Synthetic peptide
  Seed: QEAGLGQVPLIVGILLVLMAVVLA (PMEL_HUMAN)
  Core: IVGILLVLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLXVGXLXVLXAVVLA

SEQ ID NO: 334641 - protein, 24 aa, Artificial Sequence
  Description of Artificial Sequence: Synthetic peptide
  Seed: QEAGLGQVPLIVGILLVLMAVVLA (PMEL_HUMAN)
  Core: ILLVLMAVV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLIVGXLLXLXAVXLA

SEQ ID NO: 334642 - protein, 24 aa, Artificial Sequence
  Description of Artificial Sequence: Synthetic peptide
  Seed: QEAGLGQVPLIVGILLVLMAVVLA (PMEL_HUMAN)
  Core: LLVLMAVVL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLIVGIXLVXMXVVXA

SEQ ID NO: 334643 - protein, 25 aa, Artificial Sequence
  Description of Artificial Sequence: Synthetic peptide
  Seed: QEAGLGQVPLIVGILLVLMAVVLAS (PMEL_HUMAN)
  Core: LGQVPLIVG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QEAGXGQXPXIVXILLVLMAVVLAS

SEQ ID NO: 334644 - protein, 25 aa, Artificial Sequence
  Description of Artificial Sequence: Synthetic peptide
  Seed: QEAGLGQVPLIVGILLVLMAVVLAS (PMEL_HUMAN)
  Core: LIVGILLVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPXIVXIXLVXMAVVLAS

SEQ ID NO: 334645 - protein, 25 aa, Artificial Sequence
  Description of Artificial Sequence: Synthetic peptide
  Seed: QEAGLGQVPLIVGILLVLMAVVLAS (PMEL_HUMAN)
  Core: IVGILLVLM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLXVGXLXVLXAVVLAS

SEQ ID NO: 334646 - protein, 25 aa, Artificial Sequence
  Description of Artificial Sequence: Synthetic peptide
  Seed: QEAGLGQVPLIVGILLVLMAVVLAS (PMEL_HUMAN)
  Core: ILLVLMAVV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLIVGXLLXLXAVXLAS

SEQ ID NO: 334647 - protein, 25 aa, Artificial Sequence
  Description of Artificial Sequence: Synthetic peptide
  Seed: QEAGLGQVPLIVGILLVLMAVVLAS (PMEL_HUMAN)
  Core: LLVLMAVVL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QEAGLGQVPLIVGIXLVXMXVVXAS

SEQ ID NO: 334648 - protein, 13 aa, Artificial Sequence
  Description of Artificial Sequence: Synthetic peptide
  Seed: QGIESAEILQAVP (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVP

SEQ ID NO: 334649 - protein, 14 aa, Artificial Sequence
  Description of Artificial Sequence: Synthetic peptide
  Seed: QGIESAEILQAVPS (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPS

SEQ ID NO: 334650 - protein, 15 aa, Artificial Sequence
  Description of Artificial Sequence: Synthetic peptide
  Seed: QGIESAEILQAVPSG (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSG

SEQ ID NO: 334651 - protein, 15 aa, Artificial Sequence
  Description of Artificial Sequence: Synthetic peptide
  Seed: QGIESAEILQAVPSG (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSG

SEQ ID NO: 334652 - protein, 15 aa, Artificial Sequence
  Description of Artificial Sequence: Synthetic peptide
  Seed: QGIESAEILQAVPSG (PMEL_HUMAN)
  Core: AEILQAVPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QGIESXEIXQXVPXG

SEQ ID NO: 334653 - protein, 16 aa, Artificial Sequence
  Description of Artificial Sequence: Synthetic peptide
  Seed: QGIESAEILQAVPSGE (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGE

SEQ ID NO: 334654 - protein, 16 aa, Artificial Sequence
  Description of Artificial Sequence: Synthetic peptide
  Seed: QGIESAEILQAVPSGE (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSGE

SEQ ID NO: 334655 - protein, 16 aa, Artificial Sequence
  Description of Artificial Sequence: Synthetic peptide
  Seed: QGIESAEILQAVPSGE (PMEL_HUMAN)
  Core: AEILQAVPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QGIESXEIXQXVPXGE

SEQ ID NO: 334656 - protein, 17 aa, Artificial Sequence
  Description of Artificial Sequence: Synthetic peptide
  Seed: QGIESAEILQAVPSGEG (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGEG

SEQ ID NO: 334657 - protein, 17 aa, Artificial Sequence
  Description of Artificial Sequence: Synthetic peptide
  Seed: QGIESAEILQAVPSGEG (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSGEG

SEQ ID NO: 334658 - protein, 17 aa, Artificial Sequence
  Description of Artificial Sequence: Synthetic peptide
  Seed: QGIESAEILQAVPSGEG (PMEL_HUMAN)
  Core: AEILQAVPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QGIESXEIXQXVPXGEG

SEQ ID NO: 334659 - protein, 18 aa, Artificial Sequence
  Description of Artificial Sequence: Synthetic peptide
  Seed: QGIESAEILQAVPSGEGD (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGEGD

SEQ ID NO: 334660 - protein, 19 aa, Artificial Sequence
  Description of Artificial Sequence: Synthetic peptide
  Seed: QGIESAEILQAVPSGEGDA (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGEGDA

SEQ ID NO: 334661 - protein, 19 aa, Artificial Sequence
  Description of Artificial Sequence: Synthetic peptide
  Seed: QGIESAEILQAVPSGEGDA (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSGEGDA

SEQ ID NO: 334662 - protein, 19 aa, Artificial Sequence
  Description of Artificial Sequence: Synthetic peptide
  Seed: QGIESAEILQAVPSGEGDA (PMEL_HUMAN)
  Core: AEILQAVPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QGIESXEIXQXVPXGEGDA

SEQ ID NO: 334663 - protein, 19 aa, Artificial Sequence
  Description of Artificial Sequence: Synthetic peptide
  Seed: QGIESAEILQAVPSGEGDA (PMEL_HUMAN)
  Core: ILQAVPSGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEXLQXVXSGXGDA

SEQ ID NO: 334664 - protein, 19 aa, Artificial Sequence
  Description of Artificial Sequence: Synthetic peptide
  Seed: QGIESAEILQAVPSGEGDA (PMEL_HUMAN)
  Core: LQAVPSGEG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEIXQAXPXGEXDA

SEQ ID NO: 334665 - protein, 20 aa, Artificial Sequence
  Description of Artificial Sequence: Synthetic peptide
  Seed: QGIESAEILQAVPSGEGDAF (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGEGDAF

SEQ ID NO: 334666 - protein, 20 aa, Artificial Sequence
  Description of Artificial Sequence: Synthetic peptide
  Seed: QGIESAEILQAVPSGEGDAF (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSGEGDAF

SEQ ID NO: 334667 - protein, 20 aa, Artificial Sequence
  Description of Artificial Sequence: Synthetic peptide
  Seed: QGIESAEILQAVPSGEGDAF (PMEL_HUMAN)
  Core: AEILQAVPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QGIESXEIXQXVPXGEGDAF

SEQ ID NO: 334668 - protein, 20 aa, Artificial Sequence
  Description of Artificial Sequence: Synthetic peptide
  Seed: QGIESAEILQAVPSGEGDAF (PMEL_HUMAN)
  Core: ILQAVPSGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEXLQXVXSGXGDAF

SEQ ID NO: 334669 - protein, 20 aa, Artificial Sequence
  Description of Artificial Sequence: Synthetic peptide
  Seed: QGIESAEILQAVPSGEGDAF (PMEL_HUMAN)
  Core: LQAVPSGEG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEIXQAXPXGEXDAF

SEQ ID NO: 334670 - protein, 21 aa, Artificial Sequence
  Description of Artificial Sequence: Synthetic peptide
  Seed: QGIESAEILQAVPSGEGDAFE (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGEGDAFE

SEQ ID NO: 334671 - protein, 21 aa, Artificial Sequence
  Description of Artificial Sequence: Synthetic peptide
  Seed: QGIESAEILQAVPSGEGDAFE (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSGEGDAFE

SEQ ID NO: 334672 - protein, 21 aa, Artificial Sequence
  Description of Artificial Sequence: Synthetic peptide
  Seed: QGIESAEILQAVPSGEGDAFE (PMEL_HUMAN)
  Core: ILQAVPSGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEXLQXVXSGXGDAFE

SEQ ID NO: 334673 - protein, 21 aa, Artificial Sequence
  Description of Artificial Sequence: Synthetic peptide
  Seed: QGIESAEILQAVPSGEGDAFE (PMEL_HUMAN)
  Core: LQAVPSGEG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEIXQAXPXGEXDAFE

SEQ ID NO: 334674 - protein, 22 aa, Artificial Sequence
  Description of Artificial Sequence: Synthetic peptide
  Seed: QGIESAEILQAVPSGEGDAFEL (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGEGDAFEL

SEQ ID NO: 334675 - protein, 22 aa, Artificial Sequence
  Description of Artificial Sequence: Synthetic peptide
  Seed: QGIESAEILQAVPSGEGDAFEL (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSGEGDAFEL

SEQ ID NO: 334676 - protein, 22 aa, Artificial Sequence
  Description of Artificial Sequence: Synthetic peptide
  Seed: QGIESAEILQAVPSGEGDAFEL (PMEL_HUMAN)
  Core: ILQAVPSGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEXLQXVXSGXGDAFEL

SEQ ID NO: 334677 - protein, 22 aa, Artificial Sequence
  Description of Artificial Sequence: Synthetic peptide
  Seed: QGIESAEILQAVPSGEGDAFEL (PMEL_HUMAN)
  Core: LQAVPSGEG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEIXQAXPXGEXDAFEL

SEQ ID NO: 334678 - protein, 23 aa, Artificial Sequence
  Description of Artificial Sequence: Synthetic peptide
  Seed: QGIESAEILQAVPSGEGDAFELT (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGEGDAFELT

SEQ ID NO: 334679 - protein, 23 aa, Artificial Sequence
  Description of Artificial Sequence: Synthetic peptide
  Seed: QGIESAEILQAVPSGEGDAFELT (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSGEGDAFELT

SEQ ID NO: 334680 - protein, 23 aa, Artificial Sequence
  Description of Artificial Sequence: Synthetic peptide
  Seed: QGIESAEILQAVPSGEGDAFELT (PMEL_HUMAN)
  Core: ILQAVPSGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEXLQXVXSGXGDAFELT

SEQ ID NO: 334681 - protein, 23 aa, Artificial Sequence
  Description of Artificial Sequence: Synthetic peptide
  Seed: QGIESAEILQAVPSGEGDAFELT (PMEL_HUMAN)
  Core: LQAVPSGEG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEIXQAXPXGEXDAFELT

SEQ ID NO: 334682 - protein, 24 aa, Artificial Sequence
  Description of Artificial Sequence: Synthetic peptide
  Seed: QGIESAEILQAVPSGEGDAFELTV (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGEGDAFELTV

SEQ ID NO: 334683 - protein, 24 aa, Artificial Sequence
  Description of Artificial Sequence: Synthetic peptide
  Seed: QGIESAEILQAVPSGEGDAFELTV (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSGEGDAFELTV

SEQ ID NO: 334684 - protein, 24 aa, Artificial Sequence
  Description of Artificial Sequence: Synthetic peptide
  Seed: QGIESAEILQAVPSGEGDAFELTV (PMEL_HUMAN)
  Core: ILQAVPSGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEXLQXVXSGXGDAFELTV

SEQ ID NO: 334685 - protein, 24 aa, Artificial Sequence
  Description of Artificial Sequence: Synthetic peptide
  Seed: QGIESAEILQAVPSGEGDAFELTV (PMEL_HUMAN)
  Core: LQAVPSGEG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEIXQAXPXGEXDAFELTV

SEQ ID NO: 334686 - protein, 25 aa, Artificial Sequence
  Description of Artificial Sequence: Synthetic peptide
  Seed: QGIESAEILQAVPSGEGDAFELTVS (PMEL_HUMAN)
  Core: IESAEILQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QGXESXEXLQXVPSGEGDAFELTVS

SEQ ID NO: 334687 - protein, 25 aa, Artificial Sequence
  Description of Artificial Sequence: Synthetic peptide
  Seed: QGIESAEILQAVPSGEGDAFELTVS (PMEL_HUMAN)
  Core: ESAEILQAV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QGIXSAXIXQAXPSGEGDAFELTVS

SEQ ID NO: 334688 - protein, 25 aa, Artificial Sequence
  Description of Artificial Sequence: Synthetic peptide
  Seed: QGIESAEILQAVPSGEGDAFELTVS (PMEL_HUMAN)
  Core: ILQAVPSGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEXLQXVXSGXGDAFELTVS

SEQ ID NO: 334689 - protein, 25 aa, Artificial Sequence
  Description of Artificial Sequence: Synthetic peptide
  Seed: QGIESAEILQAVPSGEGDAFELTVS (PMEL_HUMAN)
  Core: LQAVPSGEG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QGIESAEIXQAXPXGEXDAFELTVS

SEQ ID NO: 334690 - protein, 14 aa, Artificial Sequence
  Description of Artificial Sequence: Synthetic peptide
  Seed: QILKGGSGTYCLNV (PMEL_HUMAN)
  Core: LKGGSGTYC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QIXKGXSXTYXLNV

SEQ ID NO: 334691 - protein, 15 aa, Artificial Sequence
  Description of Artificial Sequence: Synthetic peptide
  Seed: QILKGGSGTYCLNVS (PMEL_HUMAN)
  Core: LKGGSGTYC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QIXKGXSXTYXLNVS

SEQ ID NO: 334692 - protein, 16 aa, Artificial Sequence
  Description of Artificial Sequence: Synthetic peptide
  Seed: QILKGGSGTYCLNVSL (PMEL_HUMAN)
  Core: LKGGSGTYC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QIXKGXSXTYXLNVSL

SEQ ID NO: 334693 - protein, 17 aa, Artificial Sequence
  Description of Artificial Sequence: Synthetic peptide
  Seed: QILKGGSGTYCLNVSLA (PMEL_HUMAN)
  Core: LKGGSGTYC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QIXKGXSXTYXLNVSLA

SEQ ID NO: 334694 - protein, 19 aa, Artificial Sequence
  Description of Artificial Sequence: Synthetic peptide
  Seed: QILKGGSGTYCLNVSLADT (PMEL_HUMAN)
  Core: LKGGSGTYC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QIXKGXSXTYXLNVSLADT

SEQ ID NO: 334695 - protein, 19 aa, Artificial Sequence
  Description of Artificial Sequence: Synthetic peptide
  Seed: QILKGGSGTYCLNVSLADT (PMEL_HUMAN)
  Core: SGTYCLNVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGXGTXCXNVXLADT

SEQ ID NO: 334696 - protein, 19 aa, Artificial Sequence
  Description of Artificial Sequence: Synthetic peptide
  Seed: QILKGGSGTYCLNVSLADT (PMEL_HUMAN)
  Core: YCLNVSLAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTXCLXVXLAXT

SEQ ID NO: 334697 - protein, 20 aa, Artificial Sequence
  Description of Artificial Sequence: Synthetic peptide
  Seed: QILKGGSGTYCLNVSLADTN (PMEL_HUMAN)
  Core: SGTYCLNVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGXGTXCXNVXLADTN

SEQ ID NO: 334698 - protein, 20 aa, Artificial Sequence
  Description of Artificial Sequence: Synthetic peptide
  Seed: QILKGGSGTYCLNVSLADTN (PMEL_HUMAN)
  Core: TYCLNVSLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGXYCXNXSLXDTN

SEQ ID NO: 334699 - protein, 20 aa, Artificial Sequence
  Description of Artificial Sequence: Synthetic peptide
  Seed: QILKGGSGTYCLNVSLADTN (PMEL_HUMAN)
  Core: YCLNVSLAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTXCLXVXLAXTN

SEQ ID NO: 334700 - protein, 21 aa, Artificial Sequence
  Description of Artificial Sequence: Synthetic peptide
  Seed: QILKGGSGTYCLNVSLADTNS (PMEL_HUMAN)
  Core: YCLNVSLAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTXCLXVXLAXTNS

SEQ ID NO: 334701 - protein, 22 aa, Artificial Sequence
  Description of Artificial Sequence: Synthetic peptide
  Seed: QILKGGSGTYCLNVSLADTNSL (PMEL_HUMAN)
  Core: YCLNVSLAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTXCLXVXLAXTNSL

SEQ ID NO: 334702 - protein, 23 aa, Artificial Sequence
  Description of Artificial Sequence: Synthetic peptide
  Seed: QILKGGSGTYCLNVSLADTNSLA (PMEL_HUMAN)
  Core: TYCLNVSLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGXYCXNXSLXDTNSLA

SEQ ID NO: 334703 - protein, 23 aa, Artificial Sequence
  Description of Artificial Sequence: Synthetic peptide
  Seed: QILKGGSGTYCLNVSLADTNSLA (PMEL_HUMAN)
  Core: YCLNVSLAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTXCLXVXLAXTNSLA

SEQ ID NO: 334704 - protein, 24 aa, Artificial Sequence
  Description of Artificial Sequence: Synthetic peptide
  Seed: QILKGGSGTYCLNVSLADTNSLAV (PMEL_HUMAN)
  Core: TYCLNVSLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGXYCXNXSLXDTNSLAV

SEQ ID NO: 334705 - protein, 24 aa, Artificial Sequence
  Description of Artificial Sequence: Synthetic peptide
  Seed: QILKGGSGTYCLNVSLADTNSLAV (PMEL_HUMAN)
  Core: YCLNVSLAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTXCLXVXLAXTNSLAV

SEQ ID NO: 334706 - protein, 24 aa, Artificial Sequence
  Description of Artificial Sequence: Synthetic peptide
  Seed: QILKGGSGTYCLNVSLADTNSLAV (PMEL_HUMAN)
  Core: VSLADTNSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTYCLNXSLXDXNSXAV

SEQ ID NO: 334707 - protein, 24 aa, Artificial Sequence
  Description of Artificial Sequence: Synthetic peptide
  Seed: QILKGGSGTYCLNVSLADTNSLAV (PMEL_HUMAN)
  Core: LADTNSLAV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTYCLNVSXADXNXLAX

SEQ ID NO: 334708 - protein, 25 aa, Artificial Sequence
  Description of Artificial Sequence: Synthetic peptide
  Seed: QILKGGSGTYCLNVSLADTNSLAVV (PMEL_HUMAN)
  Core: TYCLNVSLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGXYCXNXSLXDTNSLAVV

SEQ ID NO: 334709 - protein, 25 aa, Artificial Sequence
  Description of Artificial Sequence: Synthetic peptide
  Seed: QILKGGSGTYCLNVSLADTNSLAVV (PMEL_HUMAN)
  Core: YCLNVSLAD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTXCLXVXLAXTNSLAVV

SEQ ID NO: 334710 - protein, 25 aa, Artificial Sequence
  Description of Artificial Sequence: Synthetic peptide
  Seed: QILKGGSGTYCLNVSLADTNSLAVV (PMEL_HUMAN)
  Core: LADTNSLAV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
QILKGGSGTYCLNVSXADXNXLAXV

SEQ ID NO: 334711 - protein, 13 aa, Artificial Sequence
  Description of Artificial Sequence: Synthetic peptide
  Seed: QKRSFVYVWKTWG (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWX

SEQ ID NO: 334712 - protein, 14 aa, Artificial Sequence
  Description of Artificial Sequence: Synthetic peptide
  Seed: QKRSFVYVWKTWGQ (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQ

SEQ ID NO: 334713 - protein, 14 aa, Artificial Sequence
  Description of Artificial Sequence: Synthetic peptide
  Seed: QKRSFVYVWKTWGQ (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQ

SEQ ID NO: 334714 - protein, 15 aa, Artificial Sequence
  Description of Artificial Sequence: Synthetic peptide
  Seed: QKRSFVYVWKTWGQY (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQY

SEQ ID NO: 334715 - protein, 15 aa, Artificial Sequence
  Description of Artificial Sequence: Synthetic peptide
  Seed: QKRSFVYVWKTWGQY (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQY

SEQ ID NO: 334716 - protein, 15 aa, Artificial Sequence
  Description of Artificial Sequence: Synthetic peptide
  Seed: QKRSFVYVWKTWGQY (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXY

SEQ ID NO: 334717 - protein, 15 aa, Artificial Sequence
  Description of Artificial Sequence: Synthetic peptide
  Seed: QKRSFVYVWKTWGQY (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQX

SEQ ID NO: 334718 - protein, 16 aa, Artificial Sequence
  Description of Artificial Sequence: Synthetic peptide
  Seed: QKRSFVYVWKTWGQYW (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYW

SEQ ID NO: 334719 - protein, 16 aa, Artificial Sequence
  Description of Artificial Sequence: Synthetic peptide
  Seed: QKRSFVYVWKTWGQYW (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYW

SEQ ID NO: 334720 - protein, 16 aa, Artificial Sequence
  Description of Artificial Sequence: Synthetic peptide
  Seed: QKRSFVYVWKTWGQYW (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYW

SEQ ID NO: 334721 - protein, 16 aa, Artificial Sequence
  Description of Artificial Sequence: Synthetic peptide
  Seed: QKRSFVYVWKTWGQYW (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXW

SEQ ID NO: 334722 - protein, 17 aa, Artificial Sequence
  Description of Artificial Sequence: Synthetic peptide
  Seed: QKRSFVYVWKTWGQYWQ (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYWQ

SEQ ID NO: 334723 - protein, 17 aa, Artificial Sequence
  Description of Artificial Sequence: Synthetic peptide
  Seed: QKRSFVYVWKTWGQYWQ (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYWQ

SEQ ID NO: 334724 - protein, 17 aa, Artificial Sequence
  Description of Artificial Sequence: Synthetic peptide
  Seed: QKRSFVYVWKTWGQYWQ (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYWQ

SEQ ID NO: 334725 - protein, 17 aa, Artificial Sequence
  Description of Artificial Sequence: Synthetic peptide
  Seed: QKRSFVYVWKTWGQYWQ (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXWQ

SEQ ID NO: 334726 - protein, 18 aa, Artificial Sequence
  Description of Artificial Sequence: Synthetic peptide
  Seed: QKRSFVYVWKTWGQYWQV (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYWQV

SEQ ID NO: 334727 - protein, 18 aa, Artificial Sequence
  Description of Artificial Sequence: Synthetic peptide
  Seed: QKRSFVYVWKTWGQYWQV (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYWQV

SEQ ID NO: 334728 - protein, 18 aa, Artificial Sequence
  Description of Artificial Sequence: Synthetic peptide
  Seed: QKRSFVYVWKTWGQYWQV (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYWQV

SEQ ID NO: 334729 - protein, 18 aa, Artificial Sequence
  Description of Artificial Sequence: Synthetic peptide
  Seed: QKRSFVYVWKTWGQYWQV (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXWQV

SEQ ID NO: 334730 - protein, 19 aa, Artificial Sequence
  Description of Artificial Sequence: Synthetic peptide
  Seed: QKRSFVYVWKTWGQYWQVL (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYWQVL

SEQ ID NO: 334731 - protein, 19 aa, Artificial Sequence
  Description of Artificial Sequence: Synthetic peptide
  Seed: QKRSFVYVWKTWGQYWQVL (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYWQVL

SEQ ID NO: 334732 - protein, 19 aa, Artificial Sequence
  Description of Artificial Sequence: Synthetic peptide
  Seed: QKRSFVYVWKTWGQYWQVL (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYWQVL

SEQ ID NO: 334733 - protein, 19 aa, Artificial Sequence
  Description of Artificial Sequence: Synthetic peptide
  Seed: QKRSFVYVWKTWGQYWQVL (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXWQVL

SEQ ID NO: 334734 - protein, 20 aa, Artificial Sequence
  Description of Artificial Sequence: Synthetic peptide
  Seed: QKRSFVYVWKTWGQYWQVLG (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYWQVLG

SEQ ID NO: 334735 - protein, 20 aa, Artificial Sequence
  Description of Artificial Sequence: Synthetic peptide
  Seed: QKRSFVYVWKTWGQYWQVLG (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYWQVLG

SEQ ID NO: 334736 - protein, 20 aa, Artificial Sequence
  Description of Artificial Sequence: Synthetic peptide
  Seed: QKRSFVYVWKTWGQYWQVLG (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYWQVLG

SEQ ID NO: 334737 - protein, 20 aa, Artificial Sequence
  Description of Artificial Sequence: Synthetic peptide
  Seed: QKRSFVYVWKTWGQYWQVLG (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXWQVLG

SEQ ID NO: 334738 - protein, 21 aa, Artificial Sequence
  Description of Artificial Sequence: Synthetic peptide
  Seed: QKRSFVYVWKTWGQYWQVLGG (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYWQVLGG

SEQ ID NO: 334739 - protein, 21 aa, Artificial Sequence
  Description of Artificial Sequence: Synthetic peptide
  Seed: QKRSFVYVWKTWGQYWQVLGG (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYWQVLGG

SEQ ID NO: 334740 - protein, 21 aa, Artificial Sequence
  Description of Artificial Sequence: Synthetic peptide
  Seed: QKRSFVYVWKTWGQYWQVLGG (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYWQVLGG

SEQ ID NO: 334741 - protein, 21 aa, Artificial Sequence
  Description of Artificial Sequence: Synthetic peptide
  Seed: QKRSFVYVWKTWGQYWQVLGG (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXWQVLGG

SEQ ID NO: 334742 - protein, 22 aa, Artificial Sequence
  Description of Artificial Sequence: Synthetic peptide
  Seed: QKRSFVYVWKTWGQYWQVLGGP (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYWQVLGGP

SEQ ID NO: 334743 - protein, 22 aa, Artificial Sequence
  Description of Artificial Sequence: Synthetic peptide
  Seed: QKRSFVYVWKTWGQYWQVLGGP (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYWQVLGGP

SEQ ID NO: 334744 - protein, 22 aa, Artificial Sequence
  Description of Artificial Sequence: Synthetic peptide
  Seed: QKRSFVYVWKTWGQYWQVLGGP (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYWQVLGGP

SEQ ID NO: 334745 - protein, 22 aa, Artificial Sequence
  Description of Artificial Sequence: Synthetic peptide
  Seed: QKRSFVYVWKTWGQYWQVLGGP (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXWQVLGGP

SEQ ID NO: 334746 - protein, 22 aa, Artificial Sequence
  Description of Artificial Sequence: Synthetic peptide
  Seed: QKRSFVYVWKTWGQYWQVLGGP (PMEL_HUMAN)
  Core: TWGQYWQVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKXWGXYXQVXGGP

SEQ ID NO: 334747 - protein, 23 aa, Artificial Sequence
  Description of Artificial Sequence: Synthetic peptide
  Seed: QKRSFVYVWKTWGQYWQVLGGPV (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYWQVLGGPV

SEQ ID NO: 334748 - protein, 23 aa, Artificial Sequence
  Description of Artificial Sequence: Synthetic peptide
  Seed: QKRSFVYVWKTWGQYWQVLGGPV (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYWQVLGGPV

SEQ ID NO: 334749 - protein, 23 aa, Artificial Sequence
  Description of Artificial Sequence: Synthetic peptide
  Seed: QKRSFVYVWKTWGQYWQVLGGPV (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYWQVLGGPV

SEQ ID NO: 334750 - protein, 23 aa, Artificial Sequence
  Description of Artificial Sequence: Synthetic peptide
  Seed: QKRSFVYVWKTWGQYWQVLGGPV (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXWQVLGGPV

SEQ ID NO: 334751 - protein, 23 aa, Artificial Sequence
  Description of Artificial Sequence: Synthetic peptide
  Seed: QKRSFVYVWKTWGQYWQVLGGPV (PMEL_HUMAN)
  Core: TWGQYWQVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKXWGXYXQVXGGPV

SEQ ID NO: 334752 - protein, 23 aa, Artificial Sequence
  Description of Artificial Sequence: Synthetic peptide
  Seed: QKRSFVYVWKTWGQYWQVLGGPV (PMEL_HUMAN)
  Core: YWQVLGGPV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKTWGQXWQXLXGPX

SEQ ID NO: 334753 - protein, 24 aa, Artificial Sequence
  Description of Artificial Sequence: Synthetic peptide
  Seed: QKRSFVYVWKTWGQYWQVLGGPVS (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYWQVLGGPVS

SEQ ID NO: 334754 - protein, 24 aa, Artificial Sequence
  Description of Artificial Sequence: Synthetic peptide
  Seed: QKRSFVYVWKTWGQYWQVLGGPVS (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYWQVLGGPVS

SEQ ID NO: 334755 - protein, 24 aa, Artificial Sequence
  Description of Artificial Sequence: Synthetic peptide
  Seed: QKRSFVYVWKTWGQYWQVLGGPVS (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYWQVLGGPVS

SEQ ID NO: 334756 - protein, 24 aa, Artificial Sequence
  Description of Artificial Sequence: Synthetic peptide
  Seed: QKRSFVYVWKTWGQYWQVLGGPVS (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXWQVLGGPVS

SEQ ID NO: 334757 - protein, 24 aa, Artificial Sequence
  Description of Artificial Sequence: Synthetic peptide
  Seed: QKRSFVYVWKTWGQYWQVLGGPVS (PMEL_HUMAN)
  Core: TWGQYWQVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKXWGXYXQVXGGPVS

SEQ ID NO: 334758 - protein, 24 aa, Artificial Sequence
  Description of Artificial Sequence: Synthetic peptide
  Seed: QKRSFVYVWKTWGQYWQVLGGPVS (PMEL_HUMAN)
  Core: GQYWQVLGG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKTWXQYXQXLGXPVS

SEQ ID NO: 334759 - protein, 24 aa, Artificial Sequence
  Description of Artificial Sequence: Synthetic peptide
  Seed: QKRSFVYVWKTWGQYWQVLGGPVS (PMEL_HUMAN)
  Core: YWQVLGGPV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKTWGQXWQXLXGPXS

SEQ ID NO: 334760 - protein, 25 aa, Artificial Sequence
  Description of Artificial Sequence: Synthetic peptide
  Seed: QKRSFVYVWKTWGQYWQVLGGPVSG (PMEL_HUMAN)
  Core: RSFVYVWKT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXSFXYXWKXWGQYWQVLGGPVSG

SEQ ID NO: 334761 - protein, 25 aa, Artificial Sequence
  Description of Artificial Sequence: Synthetic peptide
  Seed: QKRSFVYVWKTWGQYWQVLGGPVSG (PMEL_HUMAN)
  Core: FVYVWKTWG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QKRSXVYXWXTWXQYWQVLGGPVSG

SEQ ID NO: 334762 - protein, 25 aa, Artificial Sequence
  Description of Artificial Sequence: Synthetic peptide
  Seed: QKRSFVYVWKTWGQYWQVLGGPVSG (PMEL_HUMAN)
  Core: VYVWKTWGQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFXYVXKXWGXYWQVLGGPVSG

SEQ ID NO: 334763 - protein, 25 aa, Artificial Sequence
  Description of Artificial Sequence: Synthetic peptide
  Seed: QKRSFVYVWKTWGQYWQVLGGPVSG (PMEL_HUMAN)
  Core: YVWKTWGQY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVXVWXTXGQXWQVLGGPVSG

SEQ ID NO: 334764 - protein, 25 aa, Artificial Sequence
  Description of Artificial Sequence: Synthetic peptide
  Seed: QKRSFVYVWKTWGQYWQVLGGPVSG (PMEL_HUMAN)
  Core: TWGQYWQVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKXWGXYXQVXGGPVSG

SEQ ID NO: 334765 - protein, 25 aa, Artificial Sequence
  Description of Artificial Sequence: Synthetic peptide
  Seed: QKRSFVYVWKTWGQYWQVLGGPVSG (PMEL_HUMAN)
  Core: GQYWQVLGG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKTWXQYXQXLGXPVSG

SEQ ID NO: 334766 - protein, 25 aa, Artificial Sequence
  Description of Artificial Sequence: Synthetic peptide
  Seed: QKRSFVYVWKTWGQYWQVLGGPVSG (PMEL_HUMAN)
  Core: YWQVLGGPV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKTWGQXWQXLXGPXSG

SEQ ID NO: 334767 - protein, 25 aa, Artificial Sequence
  Description of Artificial Sequence: Synthetic peptide
  Seed: QKRSFVYVWKTWGQYWQVLGGPVSG (PMEL_HUMAN)
  Core: WQVLGGPVS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
QKRSFVYVWKTWGQYXQVXGXPVXG

SEQ ID NO: 334768 - protein, 15 aa, Artificial Sequence
  Description of Artificial Sequence: Synthetic peptide
  Seed: QKVLPDGQVIWVNNT (PMEL_HUMAN)
  Core: VLPDGQVIW
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QKXLPXGXVIXVNNT

SEQ ID NO: 334769 - protein, 16 aa, Artificial Sequence
  Description of Artificial Sequence: Synthetic peptide
  Seed: QKVLPDGQVIWVNNTI (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTX

SEQ ID NO: 334770 - protein, 17 aa, Artificial Sequence
  Description of Artificial Sequence: Synthetic peptide
  Seed: QKVLPDGQVIWVNNTII (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTXI

SEQ ID NO: 334771 - protein, 17 aa, Artificial Sequence
  Description of Artificial Sequence: Synthetic peptide
  Seed: QKVLPDGQVIWVNNTII (PMEL_HUMAN)
  Core: VIWVNNTII
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQXIWXNXTIX

SEQ ID NO: 334772 - protein, 18 aa, Artificial Sequence
  Description of Artificial Sequence: Synthetic peptide
  Seed: QKVLPDGQVIWVNNTIIN (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTXIN

SEQ ID NO: 334773 - protein, 18 aa, Artificial Sequence
  Description of Artificial Sequence: Synthetic peptide
  Seed: QKVLPDGQVIWVNNTIIN (PMEL_HUMAN)
  Core: VIWVNNTII
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQXIWXNXTIXN

SEQ ID NO: 334774 - protein, 19 aa, Artificial Sequence
  Description of Artificial Sequence: Synthetic peptide
  Seed: QKVLPDGQVIWVNNTIING (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTXING

SEQ ID NO: 334775 - protein, 19 aa, Artificial Sequence
  Description of Artificial Sequence: Synthetic peptide
  Seed: QKVLPDGQVIWVNNTIING (PMEL_HUMAN)
  Core: VIWVNNTII
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQXIWXNXTIXNG

SEQ ID NO: 334776 - protein, 19 aa, Artificial Sequence
  Description of Artificial Sequence: Synthetic peptide
  Seed: QKVLPDGQVIWVNNTIING (PMEL_HUMAN)
  Core: IWVNNTIIN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVXWVXNXIIXG

SEQ ID NO: 334777 - protein, 20 aa, Artificial Sequence
  Description of Artificial Sequence: Synthetic peptide
  Seed: QKVLPDGQVIWVNNTIINGS (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTXINGS

SEQ ID NO: 334778 - protein, 20 aa, Artificial Sequence
  Description of Artificial Sequence: Synthetic peptide
  Seed: QKVLPDGQVIWVNNTIINGS (PMEL_HUMAN)
  Core: VIWVNNTII
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQXIWXNXTIXNGS

SEQ ID NO: 334779 - protein, 20 aa, Artificial Sequence
  Description of Artificial Sequence: Synthetic peptide
  Seed: QKVLPDGQVIWVNNTIINGS (PMEL_HUMAN)
  Core: IWVNNTIIN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVXWVXNXIIXGS

SEQ ID NO: 334780 - protein, 21 aa, Artificial Sequence
  Description of Artificial Sequence: Synthetic peptide
  Seed: QKVLPDGQVIWVNNTIINGSQ (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTXINGSQ

SEQ ID NO: 334781 - protein, 21 aa, Artificial Sequence
  Description of Artificial Sequence: Synthetic peptide
  Seed: QKVLPDGQVIWVNNTIINGSQ (PMEL_HUMAN)
  Core: VIWVNNTII
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQXIWXNXTIXNGSQ

SEQ ID NO: 334782 - protein, 21 aa, Artificial Sequence
  Description of Artificial Sequence: Synthetic peptide
  Seed: QKVLPDGQVIWVNNTIINGSQ (PMEL_HUMAN)
  Core: IWVNNTIIN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVXWVXNXIIXGSQ

SEQ ID NO: 334783 - protein, 22 aa, Artificial Sequence
  Description of Artificial Sequence: Synthetic peptide
  Seed: QKVLPDGQVIWVNNTIINGSQV (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTXINGSQV

SEQ ID NO: 334784 - protein, 22 aa, Artificial Sequence
  Description of Artificial Sequence: Synthetic peptide
  Seed: QKVLPDGQVIWVNNTIINGSQV (PMEL_HUMAN)
  Core: VIWVNNTII
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQXIWXNXTIXNGSQV

SEQ ID NO: 334785 - protein, 22 aa, Artificial Sequence
  Description of Artificial Sequence: Synthetic peptide
  Seed: QKVLPDGQVIWVNNTIINGSQV (PMEL_HUMAN)
  Core: IWVNNTIIN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVXWVXNXIIXGSQV

SEQ ID NO: 334786 - protein, 23 aa, Artificial Sequence
  Description of Artificial Sequence: Synthetic peptide
  Seed: QKVLPDGQVIWVNNTIINGSQVW (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTXINGSQVW

SEQ ID NO: 334787 - protein, 23 aa, Artificial Sequence
  Description of Artificial Sequence: Synthetic peptide
  Seed: QKVLPDGQVIWVNNTIINGSQVW (PMEL_HUMAN)
  Core: VIWVNNTII
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQXIWXNXTIXNGSQVW

SEQ ID NO: 334788 - protein, 23 aa, Artificial Sequence
  Description of Artificial Sequence: Synthetic peptide
  Seed: QKVLPDGQVIWVNNTIINGSQVW (PMEL_HUMAN)
  Core: IWVNNTIIN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVXWVXNXIIXGSQVW

SEQ ID NO: 334789 - protein, 23 aa, Artificial Sequence
  Description of Artificial Sequence: Synthetic peptide
  Seed: QKVLPDGQVIWVNNTIINGSQVW (PMEL_HUMAN)
  Core: VNNTIINGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVIWXNNXIXNGXQVW

SEQ ID NO: 334790 - protein, 24 aa, Artificial Sequence
  Description of Artificial Sequence: Synthetic peptide
  Seed: QKVLPDGQVIWVNNTIINGSQVWG (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTXINGSQVWG

SEQ ID NO: 334791 - protein, 24 aa, Artificial Sequence
  Description of Artificial Sequence: Synthetic peptide
  Seed: QKVLPDGQVIWVNNTIINGSQVWG (PMEL_HUMAN)
  Core: VIWVNNTII
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQXIWXNXTIXNGSQVWG

SEQ ID NO: 334792 - protein, 24 aa, Artificial Sequence
  Description of Artificial Sequence: Synthetic peptide
  Seed: QKVLPDGQVIWVNNTIINGSQVWG (PMEL_HUMAN)
  Core: IWVNNTIIN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVXWVXNXIIXGSQVWG

SEQ ID NO: 334793 - protein, 24 aa, Artificial Sequence
  Description of Artificial Sequence: Synthetic peptide
  Seed: QKVLPDGQVIWVNNTIINGSQVWG (PMEL_HUMAN)
  Core: VNNTIINGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVIWXNNXIXNGXQVWG

SEQ ID NO: 334794 - protein, 25 aa, Artificial Sequence
  Description of Artificial Sequence: Synthetic peptide
  Seed: QKVLPDGQVIWVNNTIINGSQVWGG (PMEL_HUMAN)
  Core: QVIWVNNTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGXVIXVXNTXINGSQVWGG

SEQ ID NO: 334795 - protein, 25 aa, Artificial Sequence
  Description of Artificial Sequence: Synthetic peptide
  Seed: QKVLPDGQVIWVNNTIINGSQVWGG (PMEL_HUMAN)
  Core: VIWVNNTII
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQXIWXNXTIXNGSQVWGG

SEQ ID NO: 334796 - protein, 25 aa, Artificial Sequence
  Description of Artificial Sequence: Synthetic peptide
  Seed: QKVLPDGQVIWVNNTIINGSQVWGG (PMEL_HUMAN)
  Core: IWVNNTIIN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVXWVXNXIIXGSQVWGG

SEQ ID NO: 334797 - protein, 25 aa, Artificial Sequence
  Description of Artificial Sequence: Synthetic peptide
  Seed: QKVLPDGQVIWVNNTIINGSQVWGG (PMEL_HUMAN)
  Core: VNNTIINGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVIWXNNXIXNGXQVWGG

SEQ ID NO: 334798 - protein, 25 aa, Artificial Sequence
  Description of Artificial Sequence: Synthetic peptide
  Seed: QKVLPDGQVIWVNNTIINGSQVWGG (PMEL_HUMAN)
  Core: INGSQVWGG
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
QKVLPDGQVIWVNNTIXNGXQXWGX

SEQ ID NO: 334799 - protein, 16 aa, Artificial Sequence
  Description of Artificial Sequence: Synthetic peptide
  Seed: QLHDPSGYLAEADLSY (PMEL_HUMAN)
  Core: PSGYLAEAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLHDXSGXLXEAXLSY

SEQ ID NO: 334800 - protein, 16 aa, Artificial Sequence
  Description of Artificial Sequence: Synthetic peptide
  Seed: QLHDPSGYLAEADLSY (PMEL_HUMAN)
  Core: YLAEADLSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGXLAXAXLSX

SEQ ID NO: 334801 - protein, 19 aa, Artificial Sequence
  Description of Artificial Sequence: Synthetic peptide
  Seed: QLHDPSGYLAEADLSYTWD (PMEL_HUMAN)
  Core: YLAEADLSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGXLAXAXLSXTWD

SEQ ID NO: 334802 - protein, 20 aa, Artificial Sequence
  Description of Artificial Sequence: Synthetic peptide
  Seed: QLHDPSGYLAEADLSYTWDF (PMEL_HUMAN)
  Core: YLAEADLSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGXLAXAXLSXTWDF

SEQ ID NO: 334803 - protein, 21 aa, Artificial Sequence
  Description of Artificial Sequence: Synthetic peptide
  Seed: QLHDPSGYLAEADLSYTWDFG (PMEL_HUMAN)
  Core: PSGYLAEAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLHDXSGXLXEAXLSYTWDFG

SEQ ID NO: 334804 - protein, 21 aa, Artificial Sequence
  Description of Artificial Sequence: Synthetic peptide
  Seed: QLHDPSGYLAEADLSYTWDFG (PMEL_HUMAN)
  Core: YLAEADLSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGXLAXAXLSXTWDFG

SEQ ID NO: 334805 - protein, 22 aa, Artificial Sequence
  Description of Artificial Sequence: Synthetic peptide
  Seed: QLHDPSGYLAEADLSYTWDFGD (PMEL_HUMAN)
  Core: PSGYLAEAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLHDXSGXLXEAXLSYTWDFGD

SEQ ID NO: 334806 - protein, 22 aa, Artificial Sequence
  Description of Artificial Sequence: Synthetic peptide
  Seed: QLHDPSGYLAEADLSYTWDFGD (PMEL_HUMAN)
  Core: YLAEADLSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGXLAXAXLSXTWDFGD

SEQ ID NO: 334807 - protein, 23 aa, Artificial Sequence
  Description of Artificial Sequence: Synthetic peptide
  Seed: QLHDPSGYLAEADLSYTWDFGDS (PMEL_HUMAN)
  Core: PSGYLAEAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLHDXSGXLXEAXLSYTWDFGDS

SEQ ID NO: 334808 - protein, 23 aa, Artificial Sequence
  Description of Artificial Sequence: Synthetic peptide
  Seed: QLHDPSGYLAEADLSYTWDFGDS (PMEL_HUMAN)
  Core: YLAEADLSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGXLAXAXLSXTWDFGDS

SEQ ID NO: 334809 - protein, 23 aa, Artificial Sequence
  Description of Artificial Sequence: Synthetic peptide
  Seed: QLHDPSGYLAEADLSYTWDFGDS (PMEL_HUMAN)
  Core: LSYTWDFGD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGYLAEADXSYXWXFGXS

SEQ ID NO: 334810 - protein, 24 aa, Artificial Sequence
  Description of Artificial Sequence: Synthetic peptide
  Seed: QLHDPSGYLAEADLSYTWDFGDSS (PMEL_HUMAN)
  Core: PSGYLAEAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLHDXSGXLXEAXLSYTWDFGDSS

SEQ ID NO: 334811 - protein, 24 aa, Artificial Sequence
  Description of Artificial Sequence: Synthetic peptide
  Seed: QLHDPSGYLAEADLSYTWDFGDSS (PMEL_HUMAN)
  Core: YLAEADLSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGXLAXAXLSXTWDFGDSS

SEQ ID NO: 334812 - protein, 24 aa, Artificial Sequence
  Description of Artificial Sequence: Synthetic peptide
  Seed: QLHDPSGYLAEADLSYTWDFGDSS (PMEL_HUMAN)
  Core: LSYTWDFGD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGYLAEADXSYXWXFGXSS

SEQ ID NO: 334813 - protein, 25 aa, Artificial Sequence
  Description of Artificial Sequence: Synthetic peptide
  Seed: QLHDPSGYLAEADLSYTWDFGDSSG (PMEL_HUMAN)
  Core: YLAEADLSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGXLAXAXLSXTWDFGDSSG

SEQ ID NO: 334814 - protein, 25 aa, Artificial Sequence
  Description of Artificial Sequence: Synthetic peptide
  Seed: QLHDPSGYLAEADLSYTWDFGDSSG (PMEL_HUMAN)
  Core: LSYTWDFGD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLHDPSGYLAEADXSYXWXFGXSSG

SEQ ID NO: 334815 - protein, 15 aa, Artificial Sequence
  Description of Artificial Sequence: Synthetic peptide
  Seed: QLIMPGQEAGLGQVP (PMEL_HUMAN)
  Core: IMPGQEAGL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QLXMPXQXAGXGQVP

SEQ ID NO: 334816 - protein, 16 aa, Artificial Sequence
  Description of Artificial Sequence: Synthetic peptide
  Seed: QLIMPGQEAGLGQVPL (PMEL_HUMAN)
  Core: IMPGQEAGL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QLXMPXQXAGXGQVPL

SEQ ID NO: 334817 - protein, 17 aa, Artificial Sequence
  Description of Artificial Sequence: Synthetic peptide
  Seed: QLIMPGQEAGLGQVPLI (PMEL_HUMAN)
  Core: IMPGQEAGL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QLXMPXQXAGXGQVPLI

SEQ ID NO: 334818 - protein, 19 aa, Artificial Sequence
  Description of Artificial Sequence: Synthetic peptide
  Seed: QLIMPGQEAGLGQVPLIVG (PMEL_HUMAN)
  Core: AGLGQVPLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEXGLXQXPLXVG

SEQ ID NO: 334819 - protein, 20 aa, Artificial Sequence
  Description of Artificial Sequence: Synthetic peptide
  Seed: QLIMPGQEAGLGQVPLIVGI (PMEL_HUMAN)
  Core: AGLGQVPLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEXGLXQXPLXVGI

SEQ ID NO: 334820 - protein, 20 aa, Artificial Sequence
  Description of Artificial Sequence: Synthetic peptide
  Seed: QLIMPGQEAGLGQVPLIVGI (PMEL_HUMAN)
  Core: LGQVPLIVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEAGXGQXPXIVXI

SEQ ID NO: 334821 - protein, 21 aa, Artificial Sequence
  Description of Artificial Sequence: Synthetic peptide
  Seed: QLIMPGQEAGLGQVPLIVGIL (PMEL_HUMAN)
  Core: AGLGQVPLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEXGLXQXPLXVGIL

SEQ ID NO: 334822 - protein, 21 aa, Artificial Sequence
  Description of Artificial Sequence: Synthetic peptide
  Seed: QLIMPGQEAGLGQVPLIVGIL (PMEL_HUMAN)
  Core: LGQVPLIVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEAGXGQXPXIVXIL

SEQ ID NO: 334823 - protein, 22 aa, Artificial Sequence
  Description of Artificial Sequence: Synthetic peptide
  Seed: QLIMPGQEAGLGQVPLIVGILL (PMEL_HUMAN)
  Core: AGLGQVPLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEXGLXQXPLXVGILL

SEQ ID NO: 334824 - protein, 22 aa, Artificial Sequence
  Description of Artificial Sequence: Synthetic peptide
  Seed: QLIMPGQEAGLGQVPLIVGILL (PMEL_HUMAN)
  Core: LGQVPLIVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEAGXGQXPXIVXILL

SEQ ID NO: 334825 - protein, 23 aa, Artificial Sequence
  Description of Artificial Sequence: Synthetic peptide
  Seed: QLIMPGQEAGLGQVPLIVGILLV (PMEL_HUMAN)
  Core: AGLGQVPLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEXGLXQXPLXVGILLV

SEQ ID NO: 334826 - protein, 23 aa, Artificial Sequence
  Description of Artificial Sequence: Synthetic peptide
  Seed: QLIMPGQEAGLGQVPLIVGILLV (PMEL_HUMAN)
  Core: GLGQVPLIV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEAXLGXVXLIXGILLV

SEQ ID NO: 334827 - protein, 23 aa, Artificial Sequence
  Description of Artificial Sequence: Synthetic peptide
  Seed: QLIMPGQEAGLGQVPLIVGILLV (PMEL_HUMAN)
  Core: LGQVPLIVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEAGXGQXPXIVXILLV

SEQ ID NO: 334828 - protein, 24 aa, Artificial Sequence
  Description of Artificial Sequence: Synthetic peptide
  Seed: QLIMPGQEAGLGQVPLIVGILLVL (PMEL_HUMAN)
  Core: AGLGQVPLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEXGLXQXPLXVGILLVL

SEQ ID NO: 334829 - protein, 24 aa, Artificial Sequence
  Description of Artificial Sequence: Synthetic peptide
  Seed: QLIMPGQEAGLGQVPLIVGILLVL (PMEL_HUMAN)
  Core: GLGQVPLIV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEAXLGXVXLIXGILLVL

SEQ ID NO: 334830 - protein, 24 aa, Artificial Sequence
  Description of Artificial Sequence: Synthetic peptide
  Seed: QLIMPGQEAGLGQVPLIVGILLVL (PMEL_HUMAN)
  Core: LGQVPLIVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEAGXGQXPXIVXILLVL

SEQ ID NO: 334831 - protein, 25 aa, Artificial Sequence
  Description of Artificial Sequence: Synthetic peptide
  Seed: QLIMPGQEAGLGQVPLIVGILLVLM (PMEL_HUMAN)
  Core: EAGLGQVPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQXAGXGXVPXIVGILLVLM

SEQ ID NO: 334832 - protein, 25 aa, Artificial Sequence
  Description of Artificial Sequence: Synthetic peptide
  Seed: QLIMPGQEAGLGQVPLIVGILLVLM (PMEL_HUMAN)
  Core: AGLGQVPLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEXGLXQXPLXVGILLVLM

SEQ ID NO: 334833 - protein, 25 aa, Artificial Sequence
  Description of Artificial Sequence: Synthetic peptide
  Seed: QLIMPGQEAGLGQVPLIVGILLVLM (PMEL_HUMAN)
  Core: GLGQVPLIV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEAXLGXVXLIXGILLVLM

SEQ ID NO: 334834 - protein, 25 aa, Artificial Sequence
  Description of Artificial Sequence: Synthetic peptide
  Seed: QLIMPGQEAGLGQVPLIVGILLVLM (PMEL_HUMAN)
  Core: LGQVPLIVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLIMPGQEAGXGQXPXIVXILLVLM

SEQ ID NO: 334835 - protein, 14 aa, Artificial Sequence
  Description of Artificial Sequence: Synthetic peptide
  Seed: QLPHSSSHWLRLPR (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPR

SEQ ID NO: 334836 - protein, 15 aa, Artificial Sequence
  Description of Artificial Sequence: Synthetic peptide
  Seed: QLPHSSSHWLRLPRI (PMEL_HUMAN)
  Core: PHSSSHWLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QLXHSXSXWLXLPRI

SEQ ID NO: 334837 - protein, 15 aa, Artificial Sequence
  Description of Artificial Sequence: Synthetic peptide
  Seed: QLPHSSSHWLRLPRI (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRI

SEQ ID NO: 334838 - protein, 15 aa, Artificial Sequence
  Description of Artificial Sequence: Synthetic peptide
  Seed: QLPHSSSHWLRLPRI (PMEL_HUMAN)
  Core: SSHWLRLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSXSHXLXLPXI

SEQ ID NO: 334839 - protein, 16 aa, Artificial Sequence
  Description of Artificial Sequence: Synthetic peptide
  Seed: QLPHSSSHWLRLPRIF (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIF

SEQ ID NO: 334840 - protein, 16 aa, Artificial Sequence
  Description of Artificial Sequence: Synthetic peptide
  Seed: QLPHSSSHWLRLPRIF (PMEL_HUMAN)
  Core: SSHWLRLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSXSHXLXLPXIF

SEQ ID NO: 334841 - protein, 16 aa, Artificial Sequence
  Description of Artificial Sequence: Synthetic peptide
  Seed: QLPHSSSHWLRLPRIF (PMEL_HUMAN)
  Core: SHWLRLPRI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSXHWXRXPRXF

SEQ ID NO: 334842 - protein, 17 aa, Artificial Sequence
  Description of Artificial Sequence: Synthetic peptide
  Seed: QLPHSSSHWLRLPRIFC (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIFC

SEQ ID NO: 334843 - protein, 17 aa, Artificial Sequence
  Description of Artificial Sequence: Synthetic peptide
  Seed: QLPHSSSHWLRLPRIFC (PMEL_HUMAN)
  Core: SSHWLRLPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSXSHXLXLPXIFC

SEQ ID NO: 334844 - protein, 17 aa, Artificial Sequence
  Description of Artificial Sequence: Synthetic peptide
  Seed: QLPHSSSHWLRLPRIFC (PMEL_HUMAN)
  Core: WLRLPRIFC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHXLRXPXIFX

SEQ ID NO: 334845 - protein, 18 aa, Artificial Sequence
  Description of Artificial Sequence: Synthetic peptide
  Seed: QLPHSSSHWLRLPRIFCS (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIFCS

SEQ ID NO: 334846 - protein, 19 aa, Artificial Sequence
  Description of Artificial Sequence: Synthetic peptide
  Seed: QLPHSSSHWLRLPRIFCSC (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIFCSC

SEQ ID NO: 334847 - protein, 19 aa, Artificial Sequence
  Description of Artificial Sequence: Synthetic peptide
  Seed: QLPHSSSHWLRLPRIFCSC (PMEL_HUMAN)
  Core: SHWLRLPRI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSXHWXRXPRXFCSC

SEQ ID NO: 334848 - protein, 19 aa, Artificial Sequence
  Description of Artificial Sequence: Synthetic peptide
  Seed: QLPHSSSHWLRLPRIFCSC (PMEL_HUMAN)
  Core: WLRLPRIFC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHXLRXPXIFXSC

SEQ ID NO: 334849 - protein, 20 aa, Artificial Sequence
  Description of Artificial Sequence: Synthetic peptide
  Seed: QLPHSSSHWLRLPRIFCSCP (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIFCSCP

SEQ ID NO: 334850 - protein, 20 aa, Artificial Sequence
  Description of Artificial Sequence: Synthetic peptide
  Seed: QLPHSSSHWLRLPRIFCSCP (PMEL_HUMAN)
  Core: SHWLRLPRI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSXHWXRXPRXFCSCP

SEQ ID NO: 334851 - protein, 20 aa, Artificial Sequence
  Description of Artificial Sequence: Synthetic peptide
  Seed: QLPHSSSHWLRLPRIFCSCP (PMEL_HUMAN)
  Core: WLRLPRIFC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHXLRXPXIFXSCP

SEQ ID NO: 334852 - protein, 21 aa, Artificial Sequence
  Description of Artificial Sequence: Synthetic peptide
  Seed: QLPHSSSHWLRLPRIFCSCPI (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIFCSCPI

SEQ ID NO: 334853 - protein, 21 aa, Artificial Sequence
  Description of Artificial Sequence: Synthetic peptide
  Seed: QLPHSSSHWLRLPRIFCSCPI (PMEL_HUMAN)
  Core: SHWLRLPRI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSXHWXRXPRXFCSCPI

SEQ ID NO: 334854 - protein, 21 aa, Artificial Sequence
  Description of Artificial Sequence: Synthetic peptide
  Seed: QLPHSSSHWLRLPRIFCSCPI (PMEL_HUMAN)
  Core: WLRLPRIFC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHXLRXPXIFXSCPI

SEQ ID NO: 334855 - protein, 22 aa, Artificial Sequence
  Description of Artificial Sequence: Synthetic peptide
  Seed: QLPHSSSHWLRLPRIFCSCPIG (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIFCSCPIG

SEQ ID NO: 334856 - protein, 22 aa, Artificial Sequence
  Description of Artificial Sequence: Synthetic peptide
  Seed: QLPHSSSHWLRLPRIFCSCPIG (PMEL_HUMAN)
  Core: SHWLRLPRI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSXHWXRXPRXFCSCPIG

SEQ ID NO: 334857 - protein, 22 aa, Artificial Sequence
  Description of Artificial Sequence: Synthetic peptide
  Seed: QLPHSSSHWLRLPRIFCSCPIG (PMEL_HUMAN)
  Core: WLRLPRIFC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHXLRXPXIFXSCPIG

SEQ ID NO: 334858 - protein, 22 aa, Artificial Sequence
  Description of Artificial Sequence: Synthetic peptide
  Seed: QLPHSSSHWLRLPRIFCSCPIG (PMEL_HUMAN)
  Core: PRIFCSCPI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHWLRLXRIXCXCPXG

SEQ ID NO: 334859 - protein, 23 aa, Artificial Sequence
  Description of Artificial Sequence: Synthetic peptide
  Seed: QLPHSSSHWLRLPRIFCSCPIGE (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIFCSCPIGE

SEQ ID NO: 334860 - protein, 23 aa, Artificial Sequence
  Description of Artificial Sequence: Synthetic peptide
  Seed: QLPHSSSHWLRLPRIFCSCPIGE (PMEL_HUMAN)
  Core: SHWLRLPRI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSXHWXRXPRXFCSCPIGE

SEQ ID NO: 334861 - protein, 23 aa, Artificial Sequence
  Description of Artificial Sequence: Synthetic peptide
  Seed: QLPHSSSHWLRLPRIFCSCPIGE (PMEL_HUMAN)
  Core: WLRLPRIFC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHXLRXPXIFXSCPIGE

SEQ ID NO: 334862 - protein, 23 aa, Artificial Sequence
  Description of Artificial Sequence: Synthetic peptide
  Seed: QLPHSSSHWLRLPRIFCSCPIGE (PMEL_HUMAN)
  Core: PRIFCSCPI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHWLRLXRIXCXCPXGE

SEQ ID NO: 334863 - protein, 24 aa, Artificial Sequence
  Description of Artificial Sequence: Synthetic peptide
  Seed: QLPHSSSHWLRLPRIFCSCPIGEN (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIFCSCPIGEN

SEQ ID NO: 334864 - protein, 24 aa, Artificial Sequence
  Description of Artificial Sequence: Synthetic peptide
  Seed: QLPHSSSHWLRLPRIFCSCPIGEN (PMEL_HUMAN)
  Core: SHWLRLPRI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSXHWXRXPRXFCSCPIGEN

SEQ ID NO: 334865 - protein, 24 aa, Artificial Sequence
  Description of Artificial Sequence: Synthetic peptide
  Seed: QLPHSSSHWLRLPRIFCSCPIGEN (PMEL_HUMAN)
  Core: WLRLPRIFC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHXLRXPXIFXSCPIGEN

SEQ ID NO: 334866 - protein, 24 aa, Artificial Sequence
  Description of Artificial Sequence: Synthetic peptide
  Seed: QLPHSSSHWLRLPRIFCSCPIGEN (PMEL_HUMAN)
  Core: PRIFCSCPI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHWLRLXRIXCXCPXGEN

SEQ ID NO: 334867 - protein, 24 aa, Artificial Sequence
  Description of Artificial Sequence: Synthetic peptide
  Seed: QLPHSSSHWLRLPRIFCSCPIGEN (PMEL_HUMAN)
  Core: RIFCSCPIG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHWLRLPXIFXSXPIXEN

SEQ ID NO: 334868 - protein, 25 aa, Artificial Sequence
  Description of Artificial Sequence: Synthetic peptide
  Seed: QLPHSSSHWLRLPRIFCSCPIGENS (PMEL_HUMAN)
  Core: HSSSHWLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLPXSSXHXLRXPRIFCSCPIGENS

SEQ ID NO: 334869 - protein, 25 aa, Artificial Sequence
  Description of Artificial Sequence: Synthetic peptide
  Seed: QLPHSSSHWLRLPRIFCSCPIGENS (PMEL_HUMAN)
  Core: SHWLRLPRI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSXHWXRXPRXFCSCPIGENS

SEQ ID NO: 334870 - protein, 25 aa, Artificial Sequence
  Description of Artificial Sequence: Synthetic peptide
  Seed: QLPHSSSHWLRLPRIFCSCPIGENS (PMEL_HUMAN)
  Core: WLRLPRIFC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHXLRXPXIFXSCPIGENS

SEQ ID NO: 334871 - protein, 25 aa, Artificial Sequence
  Description of Artificial Sequence: Synthetic peptide
  Seed: QLPHSSSHWLRLPRIFCSCPIGENS (PMEL_HUMAN)
  Core: PRIFCSCPI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHWLRLXRIXCXCPXGENS

SEQ ID NO: 334872 - protein, 25 aa, Artificial Sequence
  Description of Artificial Sequence: Synthetic peptide
  Seed: QLPHSSSHWLRLPRIFCSCPIGENS (PMEL_HUMAN)
  Core: RIFCSCPIG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHWLRLPXIFXSXPIXENS

SEQ ID NO: 334873 - protein, 25 aa, Artificial Sequence
  Description of Artificial Sequence: Synthetic peptide
  Seed: QLPHSSSHWLRLPRIFCSCPIGENS (PMEL_HUMAN)
  Core: IFCSCPIGE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QLPHSSSHWLRLPRXFCXCXIGXNS

SEQ ID NO: 334874 - protein, 15 aa, Artificial Sequence
  Description of Artificial Sequence: Synthetic peptide
  Seed: QLRALDGGNKHFLRN (PMEL_HUMAN)
  Core: LRALDGGNK
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXRAXDXGNXHFLRN

SEQ ID NO: 334875 - protein, 15 aa, Artificial Sequence
  Description of Artificial Sequence: Synthetic peptide
  Seed: QLRALDGGNKHFLRN (PMEL_HUMAN)
  Core: LDGGNKHFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLRAXDGXNXHFXRN

SEQ ID NO: 334876 - protein, 20 aa, Artificial Sequence
  Description of Artificial Sequence: Synthetic peptide
  Seed: QLRALDGGNKHFLRNQPLTF (PMEL_HUMAN)
  Core: LDGGNKHFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLRAXDGXNXHFXRNQPLTF

SEQ ID NO: 334877 - protein, 20 aa, Artificial Sequence
  Description of Artificial Sequence: Synthetic peptide
  Seed: QLRALDGGNKHFLRNQPLTF (PMEL_HUMAN)
  Core: GGNKHFLRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDXGNXHXLRXQPLTF

SEQ ID NO: 334878 - protein, 20 aa, Artificial Sequence
  Description of Artificial Sequence: Synthetic peptide
  Seed: QLRALDGGNKHFLRNQPLTF (PMEL_HUMAN)
  Core: KHFLRNQPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNXHFXRXQPXTF

SEQ ID NO: 334879 - protein, 20 aa, Artificial Sequence
  Description of Artificial Sequence: Synthetic peptide
  Seed: QLRALDGGNKHFLRNQPLTF (PMEL_HUMAN)
  Core: FLRNQPLTF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHXLRXQXLTX

SEQ ID NO: 334880 - protein, 21 aa, Artificial Sequence
  Description of Artificial Sequence: Synthetic peptide
  Seed: QLRALDGGNKHFLRNQPLTFA (PMEL_HUMAN)
  Core: GGNKHFLRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDXGNXHXLRXQPLTFA

SEQ ID NO: 334881 - protein, 21 aa, Artificial Sequence
  Description of Artificial Sequence: Synthetic peptide
  Seed: QLRALDGGNKHFLRNQPLTFA (PMEL_HUMAN)
  Core: KHFLRNQPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNXHFXRXQPXTFA

SEQ ID NO: 334882 - protein, 21 aa, Artificial Sequence
  Description of Artificial Sequence: Synthetic peptide
  Seed: QLRALDGGNKHFLRNQPLTFA (PMEL_HUMAN)
  Core: FLRNQPLTF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHXLRXQXLTXA

SEQ ID NO: 334883 - protein, 22 aa, Artificial Sequence
  Description of Artificial Sequence: Synthetic peptide
  Seed: QLRALDGGNKHFLRNQPLTFAL (PMEL_HUMAN)
  Core: LDGGNKHFL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLRAXDGXNXHFXRNQPLTFAL

SEQ ID NO: 334884 - protein, 22 aa, Artificial Sequence
  Description of Artificial Sequence: Synthetic peptide
  Seed: QLRALDGGNKHFLRNQPLTFAL (PMEL_HUMAN)
  Core: GGNKHFLRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDXGNXHXLRXQPLTFAL

SEQ ID NO: 334885 - protein, 22 aa, Artificial Sequence
  Description of Artificial Sequence: Synthetic peptide
  Seed: QLRALDGGNKHFLRNQPLTFAL (PMEL_HUMAN)
  Core: KHFLRNQPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNXHFXRXQPXTFAL

SEQ ID NO: 334886 - protein, 22 aa, Artificial Sequence
  Description of Artificial Sequence: Synthetic peptide
  Seed: QLRALDGGNKHFLRNQPLTFAL (PMEL_HUMAN)
  Core: FLRNQPLTF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHXLRXQXLTXAL

SEQ ID NO: 334887 - protein, 22 aa, Artificial Sequence
  Description of Artificial Sequence: Synthetic peptide
  Seed: QLRALDGGNKHFLRNQPLTFAL (PMEL_HUMAN)
  Core: LRNQPLTFA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHFXRNXPXTFXL

SEQ ID NO: 334888 - protein, 23 aa, Artificial Sequence
  Description of Artificial Sequence: Synthetic peptide
  Seed: QLRALDGGNKHFLRNQPLTFALQ (PMEL_HUMAN)
  Core: KHFLRNQPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNXHFXRXQPXTFALQ

SEQ ID NO: 334889 - protein, 23 aa, Artificial Sequence
  Description of Artificial Sequence: Synthetic peptide
  Seed: QLRALDGGNKHFLRNQPLTFALQ (PMEL_HUMAN)
  Core: FLRNQPLTF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHXLRXQXLTXALQ

SEQ ID NO: 334890 - protein, 23 aa, Artificial Sequence
  Description of Artificial Sequence: Synthetic peptide
  Seed: QLRALDGGNKHFLRNQPLTFALQ (PMEL_HUMAN)
  Core: LRNQPLTFA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHFXRNXPXTFXLQ

SEQ ID NO: 334891 - protein, 24 aa, Artificial Sequence
  Description of Artificial Sequence: Synthetic peptide
  Seed: QLRALDGGNKHFLRNQPLTFALQL (PMEL_HUMAN)
  Core: KHFLRNQPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNXHFXRXQPXTFALQL

SEQ ID NO: 334892 - protein, 24 aa, Artificial Sequence
  Description of Artificial Sequence: Synthetic peptide
  Seed: QLRALDGGNKHFLRNQPLTFALQL (PMEL_HUMAN)
  Core: FLRNQPLTF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHXLRXQXLTXALQL

SEQ ID NO: 334893 - protein, 24 aa, Artificial Sequence
  Description of Artificial Sequence: Synthetic peptide
  Seed: QLRALDGGNKHFLRNQPLTFALQL (PMEL_HUMAN)
  Core: LRNQPLTFA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHFXRNXPXTFXLQL

SEQ ID NO: 334894 - protein, 25 aa, Artificial Sequence
  Description of Artificial Sequence: Synthetic peptide
  Seed: QLRALDGGNKHFLRNQPLTFALQLH (PMEL_HUMAN)
  Core: KHFLRNQPL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNXHFXRXQPXTFALQLH

SEQ ID NO: 334895 - protein, 25 aa, Artificial Sequence
  Description of Artificial Sequence: Synthetic peptide
  Seed: QLRALDGGNKHFLRNQPLTFALQLH (PMEL_HUMAN)
  Core: FLRNQPLTF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHXLRXQXLTXALQLH

SEQ ID NO: 334896 - protein, 25 aa, Artificial Sequence
  Description of Artificial Sequence: Synthetic peptide
  Seed: QLRALDGGNKHFLRNQPLTFALQLH (PMEL_HUMAN)
  Core: LRNQPLTFA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHFXRNXPXTFXLQLH

SEQ ID NO: 334897 - protein, 25 aa, Artificial Sequence
  Description of Artificial Sequence: Synthetic peptide
  Seed: QLRALDGGNKHFLRNQPLTFALQLH (PMEL_HUMAN)
  Core: RNQPLTFAL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QLRALDGGNKHFLXNQXLXFAXQLH

SEQ ID NO: 334898 - protein, 14 aa, Artificial Sequence
  Description of Artificial Sequence: Synthetic peptide
  Seed: QLRTKAWNRQLYPE (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPE

SEQ ID NO: 334899 - protein, 15 aa, Artificial Sequence
  Description of Artificial Sequence: Synthetic peptide
  Seed: QLRTKAWNRQLYPEW (PMEL_HUMAN)
  Core: LRTKAWNRQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXRTXAXNRXLYPEW

SEQ ID NO: 334900 - protein, 15 aa, Artificial Sequence
  Description of Artificial Sequence: Synthetic peptide
  Seed: QLRTKAWNRQLYPEW (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEW

SEQ ID NO: 334901 - protein, 16 aa, Artificial Sequence
  Description of Artificial Sequence: Synthetic peptide
  Seed: QLRTKAWNRQLYPEWT (PMEL_HUMAN)
  Core: LRTKAWNRQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXRTXAXNRXLYPEWT

SEQ ID NO: 334902 - protein, 16 aa, Artificial Sequence
  Description of Artificial Sequence: Synthetic peptide
  Seed: QLRTKAWNRQLYPEWT (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWT

SEQ ID NO: 334903 - protein, 17 aa, Artificial Sequence
  Description of Artificial Sequence: Synthetic peptide
  Seed: QLRTKAWNRQLYPEWTE (PMEL_HUMAN)
  Core: LRTKAWNRQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXRTXAXNRXLYPEWTE

SEQ ID NO: 334904 - protein, 17 aa, Artificial Sequence
  Description of Artificial Sequence: Synthetic peptide
  Seed: QLRTKAWNRQLYPEWTE (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWTE

SEQ ID NO: 334905 - protein, 18 aa, Artificial Sequence
  Description of Artificial Sequence: Synthetic peptide
  Seed: QLRTKAWNRQLYPEWTEA (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWTEA

SEQ ID NO: 334906 - protein, 19 aa, Artificial Sequence
  Description of Artificial Sequence: Synthetic peptide
  Seed: QLRTKAWNRQLYPEWTEAQ (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWTEAQ

SEQ ID NO: 334907 - protein, 19 aa, Artificial Sequence
  Description of Artificial Sequence: Synthetic peptide
  Seed: QLRTKAWNRQLYPEWTEAQ (PMEL_HUMAN)
  Core: NRQLYPEWT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWXRQXYXEWXEAQ

SEQ ID NO: 334908 - protein, 20 aa, Artificial Sequence
  Description of Artificial Sequence: Synthetic peptide
  Seed: QLRTKAWNRQLYPEWTEAQR (PMEL_HUMAN)
  Core: LRTKAWNRQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXRTXAXNRXLYPEWTEAQR

SEQ ID NO: 334909 - protein, 20 aa, Artificial Sequence
  Description of Artificial Sequence: Synthetic peptide
  Seed: QLRTKAWNRQLYPEWTEAQR (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWTEAQR

SEQ ID NO: 334910 - protein, 20 aa, Artificial Sequence
  Description of Artificial Sequence: Synthetic peptide
  Seed: QLRTKAWNRQLYPEWTEAQR (PMEL_HUMAN)
  Core: WNRQLYPEW
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAXNRXLXPEXTEAQR

SEQ ID NO: 334911 - protein, 20 aa, Artificial Sequence
  Description of Artificial Sequence: Synthetic peptide
  Seed: QLRTKAWNRQLYPEWTEAQR (PMEL_HUMAN)
  Core: NRQLYPEWT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWXRQXYXEWXEAQR

SEQ ID NO: 334912 - protein, 20 aa, Artificial Sequence
  Description of Artificial Sequence: Synthetic peptide
  Seed: QLRTKAWNRQLYPEWTEAQR (PMEL_HUMAN)
  Core: QLYPEWTEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWNRXLYXEXTEXQR

SEQ ID NO: 334913 - protein, 20 aa, Artificial Sequence
  Description of Artificial Sequence: Synthetic peptide
  Seed: QLRTKAWNRQLYPEWTEAQR (PMEL_HUMAN)
  Core: LYPEWTEAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWNRQXYPXWXEAXR

SEQ ID NO: 334914 - protein, 21 aa, Artificial Sequence
  Description of Artificial Sequence: Synthetic peptide
  Seed: QLRTKAWNRQLYPEWTEAQRL (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWTEAQRL

SEQ ID NO: 334915 - protein, 21 aa, Artificial Sequence
  Description of Artificial Sequence: Synthetic peptide
  Seed: QLRTKAWNRQLYPEWTEAQRL (PMEL_HUMAN)
  Core: WNRQLYPEW
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAXNRXLXPEXTEAQRL

SEQ ID NO: 334916 - protein, 21 aa, Artificial Sequence
  Description of Artificial Sequence: Synthetic peptide
  Seed: QLRTKAWNRQLYPEWTEAQRL (PMEL_HUMAN)
  Core: NRQLYPEWT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWXRQXYXEWXEAQRL

SEQ ID NO: 334917 - protein, 21 aa, Artificial Sequence
  Description of Artificial Sequence: Synthetic peptide
  Seed: QLRTKAWNRQLYPEWTEAQRL (PMEL_HUMAN)
  Core: LYPEWTEAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWNRQXYPXWXEAXRL

SEQ ID NO: 334918 - protein, 22 aa, Artificial Sequence
  Description of Artificial Sequence: Synthetic peptide
  Seed: QLRTKAWNRQLYPEWTEAQRLD (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWTEAQRLD

SEQ ID NO: 334919 - protein, 22 aa, Artificial Sequence
  Description of Artificial Sequence: Synthetic peptide
  Seed: QLRTKAWNRQLYPEWTEAQRLD (PMEL_HUMAN)
  Core: LYPEWTEAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWNRQXYPXWXEAXRLD

SEQ ID NO: 334920 - protein, 23 aa, Artificial Sequence
  Description of Artificial Sequence: Synthetic peptide
  Seed: QLRTKAWNRQLYPEWTEAQRLDC (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWTEAQRLDC

SEQ ID NO: 334921 - protein, 23 aa, Artificial Sequence
  Description of Artificial Sequence: Synthetic peptide
  Seed: QLRTKAWNRQLYPEWTEAQRLDC (PMEL_HUMAN)
  Core: LYPEWTEAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWNRQXYPXWXEAXRLDC

SEQ ID NO: 334922 - protein, 24 aa, Artificial Sequence
  Description of Artificial Sequence: Synthetic peptide
  Seed: QLRTKAWNRQLYPEWTEAQRLDCW (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWTEAQRLDCW

SEQ ID NO: 334923 - protein, 24 aa, Artificial Sequence
  Description of Artificial Sequence: Synthetic peptide
  Seed: QLRTKAWNRQLYPEWTEAQRLDCW (PMEL_HUMAN)
  Core: LYPEWTEAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWNRQXYPXWXEAXRLDCW

SEQ ID NO: 334924 - protein, 25 aa, Artificial Sequence
  Description of Artificial Sequence: Synthetic peptide
  Seed: QLRTKAWNRQLYPEWTEAQRLDCWR (PMEL_HUMAN)
  Core: TKAWNRQLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLRXKAXNXQLXPEWTEAQRLDCWR

SEQ ID NO: 334925 - protein, 25 aa, Artificial Sequence
  Description of Artificial Sequence: Synthetic peptide
  Seed: QLRTKAWNRQLYPEWTEAQRLDCWR (PMEL_HUMAN)
  Core: LYPEWTEAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QLRTKAWNRQXYPXWXEAXRLDCWR

SEQ ID NO: 334926 - protein, 13 aa, Artificial Sequence
  Description of Artificial Sequence: Synthetic peptide
  Seed: QLVLHQILKGGSG (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXG

SEQ ID NO: 334927 - protein, 14 aa, Artificial Sequence
  Description of Artificial Sequence: Synthetic peptide
  Seed: QLVLHQILKGGSGT (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGT

SEQ ID NO: 334928 - protein, 14 aa, Artificial Sequence
  Description of Artificial Sequence: Synthetic peptide
  Seed: QLVLHQILKGGSGT (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGT

SEQ ID NO: 334929 - protein, 15 aa, Artificial Sequence
  Description of Artificial Sequence: Synthetic peptide
  Seed: QLVLHQILKGGSGTY (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTY

SEQ ID NO: 334930 - protein, 15 aa, Artificial Sequence
  Description of Artificial Sequence: Synthetic peptide
  Seed: QLVLHQILKGGSGTY (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTY

SEQ ID NO: 334931 - protein, 15 aa, Artificial Sequence
  Description of Artificial Sequence: Synthetic peptide
  Seed: QLVLHQILKGGSGTY (PMEL_HUMAN)
  Core: HQILKGGSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLVLXQIXKXGSXTY

SEQ ID NO: 334932 - protein, 16 aa, Artificial Sequence
  Description of Artificial Sequence: Synthetic peptide
  Seed: QLVLHQILKGGSGTYC (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTYC

SEQ ID NO: 334933 - protein, 16 aa, Artificial Sequence
  Description of Artificial Sequence: Synthetic peptide
  Seed: QLVLHQILKGGSGTYC (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYC

SEQ ID NO: 334934 - protein, 17 aa, Artificial Sequence
  Description of Artificial Sequence: Synthetic peptide
  Seed: QLVLHQILKGGSGTYCL (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTYCL

SEQ ID NO: 334935 - protein, 17 aa, Artificial Sequence
  Description of Artificial Sequence: Synthetic peptide
  Seed: QLVLHQILKGGSGTYCL (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYCL

SEQ ID NO: 334936 - protein, 17 aa, Artificial Sequence
  Description of Artificial Sequence: Synthetic peptide
  Seed: QLVLHQILKGGSGTYCL (PMEL_HUMAN)
  Core: HQILKGGSG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QLVLXQIXKXGSXTYCL

SEQ ID NO: 334937 - protein, 18 aa, Artificial Sequence
  Description of Artificial Sequence: Synthetic peptide
  Seed: QLVLHQILKGGSGTYCLN (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYCLN

SEQ ID NO: 334938 - protein, 19 aa, Artificial Sequence
  Description of Artificial Sequence: Synthetic peptide
  Seed: QLVLHQILKGGSGTYCLNV (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTYCLNV

SEQ ID NO: 334939 - protein, 19 aa, Artificial Sequence
  Description of Artificial Sequence: Synthetic peptide
  Seed: QLVLHQILKGGSGTYCLNV (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYCLNV

SEQ ID NO: 334940 - protein, 19 aa, Artificial Sequence
  Description of Artificial Sequence: Synthetic peptide
  Seed: QLVLHQILKGGSGTYCLNV (PMEL_HUMAN)
  Core: LKGGSGTYC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLVLHQIXKGXSXTYXLNV

SEQ ID NO: 334941 - protein, 20 aa, Artificial Sequence
  Description of Artificial Sequence: Synthetic peptide
  Seed: QLVLHQILKGGSGTYCLNVS (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTYCLNVS

SEQ ID NO: 334942 - protein, 20 aa, Artificial Sequence
  Description of Artificial Sequence: Synthetic peptide
  Seed: QLVLHQILKGGSGTYCLNVS (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYCLNVS

SEQ ID NO: 334943 - protein, 20 aa, Artificial Sequence
  Description of Artificial Sequence: Synthetic peptide
  Seed: QLVLHQILKGGSGTYCLNVS (PMEL_HUMAN)
  Core: LKGGSGTYC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLVLHQIXKGXSXTYXLNVS

SEQ ID NO: 334944 - protein, 21 aa, Artificial Sequence
  Description of Artificial Sequence: Synthetic peptide
  Seed: QLVLHQILKGGSGTYCLNVSL (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTYCLNVSL

SEQ ID NO: 334945 - protein, 21 aa, Artificial Sequence
  Description of Artificial Sequence: Synthetic peptide
  Seed: QLVLHQILKGGSGTYCLNVSL (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYCLNVSL

SEQ ID NO: 334946 - protein, 22 aa, Artificial Sequence
  Description of Artificial Sequence: Synthetic peptide
  Seed: QLVLHQILKGGSGTYCLNVSLA (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTYCLNVSLA

SEQ ID NO: 334947 - protein, 22 aa, Artificial Sequence
  Description of Artificial Sequence: Synthetic peptide
  Seed: QLVLHQILKGGSGTYCLNVSLA (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYCLNVSLA

SEQ ID NO: 334948 - protein, 23 aa, Artificial Sequence
  Description of Artificial Sequence: Synthetic peptide
  Seed: QLVLHQILKGGSGTYCLNVSLAD (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTYCLNVSLAD

SEQ ID NO: 334949 - protein, 23 aa, Artificial Sequence
  Description of Artificial Sequence: Synthetic peptide
  Seed: QLVLHQILKGGSGTYCLNVSLAD (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYCLNVSLAD

SEQ ID NO: 334950 - protein, 23 aa, Artificial Sequence
  Description of Artificial Sequence: Synthetic peptide
  Seed: QLVLHQILKGGSGTYCLNVSLAD (PMEL_HUMAN)
  Core: LKGGSGTYC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLVLHQIXKGXSXTYXLNVSLAD

SEQ ID NO: 334951 - protein, 24 aa, Artificial Sequence
  Description of Artificial Sequence: Synthetic peptide
  Seed: QLVLHQILKGGSGTYCLNVSLADT (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTYCLNVSLADT

SEQ ID NO: 334952 - protein, 24 aa, Artificial Sequence
  Description of Artificial Sequence: Synthetic peptide
  Seed: QLVLHQILKGGSGTYCLNVSLADT (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYCLNVSLADT

SEQ ID NO: 334953 - protein, 24 aa, Artificial Sequence
  Description of Artificial Sequence: Synthetic peptide
  Seed: QLVLHQILKGGSGTYCLNVSLADT (PMEL_HUMAN)
  Core: LKGGSGTYC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QLVLHQIXKGXSXTYXLNVSLADT

SEQ ID NO: 334954 - protein, 24 aa, Artificial Sequence
  Description of Artificial Sequence: Synthetic peptide
  Seed: QLVLHQILKGGSGTYCLNVSLADT (PMEL_HUMAN)
  Core: YCLNVSLAD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QLVLHQILKGGSGTXCLXVXLAXT

SEQ ID NO: 334955 - protein, 25 aa, Artificial Sequence
  Description of Artificial Sequence: Synthetic peptide
  Seed: QLVLHQILKGGSGTYCLNVSLADTN (PMEL_HUMAN)
  Core: LVLHQILKG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXQXLKXGSGTYCLNVSLADTN

SEQ ID NO: 334956 - protein, 25 aa, Artificial Sequence
  Description of Artificial Sequence: Synthetic peptide
  Seed: QLVLHQILKGGSGTYCLNVSLADTN (PMEL_HUMAN)
  Core: LHQILKGGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLVXHQXLXGGXGTYCLNVSLADTN

SEQ ID NO: 334957 - protein, 25 aa, Artificial Sequence
  Description of Artificial Sequence: Synthetic peptide
  Seed: QLVLHQILKGGSGTYCLNVSLADTN (PMEL_HUMAN)
  Core: YCLNVSLAD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QLVLHQILKGGSGTXCLXVXLAXTN

SEQ ID NO: 334958 - protein, 20 aa, Artificial Sequence
  Description of Artificial Sequence: Synthetic peptide
  Seed: QLYPEWTEAQRLDCWRGGQV (PMEL_HUMAN)
  Core: PEWTEAQRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QLYXEWXEXQRXDCWRGGQV

SEQ ID NO: 334959 - protein, 25 aa, Artificial Sequence
  Description of Artificial Sequence: Synthetic peptide
  Seed: QLYPEWTEAQRLDCWRGGQVSLKVS (PMEL_HUMAN)
  Core: WRGGQVSLK
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QLYPEWTEAQRLDCXRGXQXSLXVS

SEQ ID NO: 334960 - protein, 20 aa, Artificial Sequence
  Description of Artificial Sequence: Synthetic peptide
  Seed: QMPTAESTGMTPEKVPVSEV (PMEL_HUMAN)
  Core: STGMTPEKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QMPTAEXTGXTXEKXPVSEV

SEQ ID NO: 334961 - protein, 14 aa, Artificial Sequence
  Description of Artificial Sequence: Synthetic peptide
  Seed: QPLTFALQLHDPSG (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSG

SEQ ID NO: 334962 - protein, 14 aa, Artificial Sequence
  Description of Artificial Sequence: Synthetic peptide
  Seed: QPLTFALQLHDPSG (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXG

SEQ ID NO: 334963 - protein, 15 aa, Artificial Sequence
  Description of Artificial Sequence: Synthetic peptide
  Seed: QPLTFALQLHDPSGY (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGY

SEQ ID NO: 334964 - protein, 15 aa, Artificial Sequence
  Description of Artificial Sequence: Synthetic peptide
  Seed: QPLTFALQLHDPSGY (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXGY

SEQ ID NO: 334965 - protein, 16 aa, Artificial Sequence
  Description of Artificial Sequence: Synthetic peptide
  Seed: QPLTFALQLHDPSGYL (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYL

SEQ ID NO: 334966 - protein, 16 aa, Artificial Sequence
  Description of Artificial Sequence: Synthetic peptide
  Seed: QPLTFALQLHDPSGYL (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXGYL

SEQ ID NO: 334967 - protein, 16 aa, Artificial Sequence
  Description of Artificial Sequence: Synthetic peptide
  Seed: QPLTFALQLHDPSGYL (PMEL_HUMAN)
  Core: LQLHDPSGY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFAXQLXDXSGXL

SEQ ID NO: 334968 - protein, 17 aa, Artificial Sequence
  Description of Artificial Sequence: Synthetic peptide
  Seed: QPLTFALQLHDPSGYLA (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYLA

SEQ ID NO: 334969 - protein, 17 aa, Artificial Sequence
  Description of Artificial Sequence: Synthetic peptide
  Seed: QPLTFALQLHDPSGYLA (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXGYLA

SEQ ID NO: 334970 - protein, 17 aa, Artificial Sequence
  Description of Artificial Sequence: Synthetic peptide
  Seed: QPLTFALQLHDPSGYLA (PMEL_HUMAN)
  Core: ALQLHDPSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFXLQXHXPSXYLA

SEQ ID NO: 334971 - protein, 17 aa, Artificial Sequence
  Description of Artificial Sequence: Synthetic peptide
  Seed: QPLTFALQLHDPSGYLA (PMEL_HUMAN)
  Core: LQLHDPSGY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFAXQLXDXSGXLA

SEQ ID NO: 334972 - protein, 18 aa, Artificial Sequence
  Description of Artificial Sequence: Synthetic peptide
  Seed: QPLTFALQLHDPSGYLAE (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYLAE

SEQ ID NO: 334973 - protein, 19 aa, Artificial Sequence
  Description of Artificial Sequence: Synthetic peptide
  Seed: QPLTFALQLHDPSGYLAEA (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYLAEA

SEQ ID NO: 334974 - protein, 19 aa, Artificial Sequence
  Description of Artificial Sequence: Synthetic peptide
  Seed: QPLTFALQLHDPSGYLAEA (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXGYLAEA

SEQ ID NO: 334975 - protein, 19 aa, Artificial Sequence
  Description of Artificial Sequence: Synthetic peptide
  Seed: QPLTFALQLHDPSGYLAEA (PMEL_HUMAN)
  Core: ALQLHDPSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFXLQXHXPSXYLAEA

SEQ ID NO: 334976 - protein, 19 aa, Artificial Sequence
  Description of Artificial Sequence: Synthetic peptide
  Seed: QPLTFALQLHDPSGYLAEA (PMEL_HUMAN)
  Core: LQLHDPSGY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFAXQLXDXSGXLAEA

SEQ ID NO: 334977 - protein, 20 aa, Artificial Sequence
  Description of Artificial Sequence: Synthetic peptide
  Seed: QPLTFALQLHDPSGYLAEAD (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYLAEAD

SEQ ID NO: 334978 - protein, 20 aa, Artificial Sequence
  Description of Artificial Sequence: Synthetic peptide
  Seed: QPLTFALQLHDPSGYLAEAD (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXGYLAEAD

SEQ ID NO: 334979 - protein, 20 aa, Artificial Sequence
  Description of Artificial Sequence: Synthetic peptide
  Seed: QPLTFALQLHDPSGYLAEAD (PMEL_HUMAN)
  Core: LQLHDPSGY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFAXQLXDXSGXLAEAD

SEQ ID NO: 334980 - protein, 20 aa, Artificial Sequence
  Description of Artificial Sequence: Synthetic peptide
  Seed: QPLTFALQLHDPSGYLAEAD (PMEL_HUMAN)
  Core: LHDPSGYLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQXHDXSXYLXEAD

SEQ ID NO: 334981 - protein, 20 aa, Artificial Sequence
  Description of Artificial Sequence: Synthetic peptide
  Seed: QPLTFALQLHDPSGYLAEAD (PMEL_HUMAN)
  Core: PSGYLAEAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQLHDXSGXLXEAX

SEQ ID NO: 334982 - protein, 21 aa, Artificial Sequence
  Description of Artificial Sequence: Synthetic peptide
  Seed: QPLTFALQLHDPSGYLAEADL (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYLAEADL

SEQ ID NO: 334983 - protein, 21 aa, Artificial Sequence
  Description of Artificial Sequence: Synthetic peptide
  Seed: QPLTFALQLHDPSGYLAEADL (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXGYLAEADL

SEQ ID NO: 334984 - protein, 21 aa, Artificial Sequence
  Description of Artificial Sequence: Synthetic peptide
  Seed: QPLTFALQLHDPSGYLAEADL (PMEL_HUMAN)
  Core: LQLHDPSGY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFAXQLXDXSGXLAEADL

SEQ ID NO: 334985 - protein, 21 aa, Artificial Sequence
  Description of Artificial Sequence: Synthetic peptide
  Seed: QPLTFALQLHDPSGYLAEADL (PMEL_HUMAN)
  Core: LHDPSGYLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQXHDXSXYLXEADL

SEQ ID NO: 334986 - protein, 21 aa, Artificial Sequence
  Description of Artificial Sequence: Synthetic peptide
  Seed: QPLTFALQLHDPSGYLAEADL (PMEL_HUMAN)
  Core: PSGYLAEAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQLHDXSGXLXEAXL

SEQ ID NO: 334987 - protein, 22 aa, Artificial Sequence
  Description of Artificial Sequence: Synthetic peptide
  Seed: QPLTFALQLHDPSGYLAEADLS (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYLAEADLS

SEQ ID NO: 334988 - protein, 22 aa, Artificial Sequence
  Description of Artificial Sequence: Synthetic peptide
  Seed: QPLTFALQLHDPSGYLAEADLS (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXGYLAEADLS

SEQ ID NO: 334989 - protein, 22 aa, Artificial Sequence
  Description of Artificial Sequence: Synthetic peptide
  Seed: QPLTFALQLHDPSGYLAEADLS (PMEL_HUMAN)
  Core: LQLHDPSGY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFAXQLXDXSGXLAEADLS

SEQ ID NO: 334990 - protein, 22 aa, Artificial Sequence
  Description of Artificial Sequence: Synthetic peptide
  Seed: QPLTFALQLHDPSGYLAEADLS (PMEL_HUMAN)
  Core: LHDPSGYLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQXHDXSXYLXEADLS

SEQ ID NO: 334991 - protein, 22 aa, Artificial Sequence
  Description of Artificial Sequence: Synthetic peptide
  Seed: QPLTFALQLHDPSGYLAEADLS (PMEL_HUMAN)
  Core: PSGYLAEAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQLHDXSGXLXEAXLS

SEQ ID NO: 334992 - protein, 23 aa, Artificial Sequence
  Description of Artificial Sequence: Synthetic peptide
  Seed: QPLTFALQLHDPSGYLAEADLSY (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYLAEADLSY

SEQ ID NO: 334993 - protein, 23 aa, Artificial Sequence
  Description of Artificial Sequence: Synthetic peptide
  Seed: QPLTFALQLHDPSGYLAEADLSY (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXGYLAEADLSY

SEQ ID NO: 334994 - protein, 23 aa, Artificial Sequence
  Description of Artificial Sequence: Synthetic peptide
  Seed: QPLTFALQLHDPSGYLAEADLSY (PMEL_HUMAN)
  Core: LQLHDPSGY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFAXQLXDXSGXLAEADLSY

SEQ ID NO: 334995 - protein, 23 aa, Artificial Sequence
  Description of Artificial Sequence: Synthetic peptide
  Seed: QPLTFALQLHDPSGYLAEADLSY (PMEL_HUMAN)
  Core: LHDPSGYLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQXHDXSXYLXEADLSY

SEQ ID NO: 334996 - protein, 23 aa, Artificial Sequence
  Description of Artificial Sequence: Synthetic peptide
  Seed: QPLTFALQLHDPSGYLAEADLSY (PMEL_HUMAN)
  Core: PSGYLAEAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQLHDXSGXLXEAXLSY

SEQ ID NO: 334997 - protein, 23 aa, Artificial Sequence
  Description of Artificial Sequence: Synthetic peptide
  Seed: QPLTFALQLHDPSGYLAEADLSY (PMEL_HUMAN)
  Core: YLAEADLSY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQLHDPSGXLAXAXLSX

SEQ ID NO: 334998 - protein, 24 aa, Artificial Sequence
  Description of Artificial Sequence: Synthetic peptide
  Seed: QPLTFALQLHDPSGYLAEADLSYT (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYLAEADLSYT

SEQ ID NO: 334999 - protein, 24 aa, Artificial Sequence
  Description of Artificial Sequence: Synthetic peptide
  Seed: QPLTFALQLHDPSGYLAEADLSYT (PMEL_HUMAN)
  Core: FALQLHDPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QPLTXALXLXDPXGYLAEADLSYT

SEQ ID NO: 335000 - protein, 24 aa, Artificial Sequence
  Description of Artificial Sequence: Synthetic peptide
  Seed: QPLTFALQLHDPSGYLAEADLSYT (PMEL_HUMAN)
  Core: LQLHDPSGY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFAXQLXDXSGXLAEADLSYT

SEQ ID NO: 335001 - protein, 24 aa, Artificial Sequence
  Description of Artificial Sequence: Synthetic peptide
  Seed: QPLTFALQLHDPSGYLAEADLSYT (PMEL_HUMAN)
  Core: LHDPSGYLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQXHDXSXYLXEADLSYT

SEQ ID NO: 335002 - protein, 24 aa, Artificial Sequence
  Description of Artificial Sequence: Synthetic peptide
  Seed: QPLTFALQLHDPSGYLAEADLSYT (PMEL_HUMAN)
  Core: PSGYLAEAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQLHDXSGXLXEAXLSYT

SEQ ID NO: 335003 - protein, 24 aa, Artificial Sequence
  Description of Artificial Sequence: Synthetic peptide
  Seed: QPLTFALQLHDPSGYLAEADLSYT (PMEL_HUMAN)
  Core: YLAEADLSY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQLHDPSGXLAXAXLSXT

SEQ ID NO: 335004 - protein, 25 aa, Artificial Sequence
  Description of Artificial Sequence: Synthetic peptide
  Seed: QPLTFALQLHDPSGYLAEADLSYTW (PMEL_HUMAN)
  Core: LTFALQLHD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXTFXLXLHXPSGYLAEADLSYTW

SEQ ID NO: 335005 - protein, 25 aa, Artificial Sequence
  Description of Artificial Sequence: Synthetic peptide
  Seed: QPLTFALQLHDPSGYLAEADLSYTW (PMEL_HUMAN)
  Core: LQLHDPSGY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFAXQLXDXSGXLAEADLSYTW

SEQ ID NO: 335006 - protein, 25 aa, Artificial Sequence
  Description of Artificial Sequence: Synthetic peptide
  Seed: QPLTFALQLHDPSGYLAEADLSYTW (PMEL_HUMAN)
  Core: PSGYLAEAD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQLHDXSGXLXEAXLSYTW

SEQ ID NO: 335007 - protein, 25 aa, Artificial Sequence
  Description of Artificial Sequence: Synthetic peptide
  Seed: QPLTFALQLHDPSGYLAEADLSYTW (PMEL_HUMAN)
  Core: YLAEADLSY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QPLTFALQLHDPSGXLAXAXLSXTW

SEQ ID NO: 335008 - protein, 20 aa, Artificial Sequence
  Description of Artificial Sequence: Synthetic peptide
  Seed: QPPAQRLCQPVLPSPACQLV (PMEL_HUMAN)
  Core: RLCQPVLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQXLCXPXLPXPACQLV

SEQ ID NO: 335009 - protein, 20 aa, Artificial Sequence
  Description of Artificial Sequence: Synthetic peptide
  Seed: QPPAQRLCQPVLPSPACQLV (PMEL_HUMAN)
  Core: CQPVLPSPA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQRLXQPXLXSPXCQLV

SEQ ID NO: 335010 - protein, 20 aa, Artificial Sequence
  Description of Artificial Sequence: Synthetic peptide
  Seed: QPPAQRLCQPVLPSPACQLV (PMEL_HUMAN)
  Core: VLPSPACQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQRLCQPXLPXPXCQXV

SEQ ID NO: 335011 - protein, 21 aa, Artificial Sequence
  Description of Artificial Sequence: Synthetic peptide
  Seed: QPPAQRLCQPVLPSPACQLVL (PMEL_HUMAN)
  Core: RLCQPVLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQXLCXPXLPXPACQLVL

SEQ ID NO: 335012 - protein, 21 aa, Artificial Sequence
  Description of Artificial Sequence: Synthetic peptide
  Seed: QPPAQRLCQPVLPSPACQLVL (PMEL_HUMAN)
  Core: VLPSPACQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQRLCQPXLPXPXCQXVL

SEQ ID NO: 335013 - protein, 22 aa, Artificial Sequence
  Description of Artificial Sequence: Synthetic peptide
  Seed: QPPAQRLCQPVLPSPACQLVLH (PMEL_HUMAN)
  Core: VLPSPACQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQRLCQPXLPXPXCQXVLH

SEQ ID NO: 335014 - protein, 23 aa, Artificial Sequence
  Description of Artificial Sequence: Synthetic peptide
  Seed: QPPAQRLCQPVLPSPACQLVLHQ (PMEL_HUMAN)
  Core: VLPSPACQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQRLCQPXLPXPXCQXVLHQ

SEQ ID NO: 335015 - protein, 24 aa, Artificial Sequence
  Description of Artificial Sequence: Synthetic peptide
  Seed: QPPAQRLCQPVLPSPACQLVLHQI (PMEL_HUMAN)
  Core: RLCQPVLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQXLCXPXLPXPACQLVLHQI

SEQ ID NO: 335016 - protein, 24 aa, Artificial Sequence
  Description of Artificial Sequence: Synthetic peptide
  Seed: QPPAQRLCQPVLPSPACQLVLHQI (PMEL_HUMAN)
  Core: VLPSPACQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQRLCQPXLPXPXCQXVLHQI

SEQ ID NO: 335017 - protein, 25 aa, Artificial Sequence
  Description of Artificial Sequence: Synthetic peptide
  Seed: QPPAQRLCQPVLPSPACQLVLHQIL (PMEL_HUMAN)
  Core: PAQRLCQPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXAQXLXQPXLPSPACQLVLHQIL

SEQ ID NO: 335018 - protein, 25 aa, Artificial Sequence
  Description of Artificial Sequence: Synthetic peptide
  Seed: QPPAQRLCQPVLPSPACQLVLHQIL (PMEL_HUMAN)
  Core: RLCQPVLPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQXLCXPXLPXPACQLVLHQIL

SEQ ID NO: 335019 - protein, 25 aa, Artificial Sequence
  Description of Artificial Sequence: Synthetic peptide
  Seed: QPPAQRLCQPVLPSPACQLVLHQIL (PMEL_HUMAN)
  Core: CQPVLPSPA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQRLXQPXLXSPXCQLVLHQIL

SEQ ID NO: 335020 - protein, 25 aa, Artificial Sequence
  Description of Artificial Sequence: Synthetic peptide
  Seed: QPPAQRLCQPVLPSPACQLVLHQIL (PMEL_HUMAN)
  Core: VLPSPACQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPPAQRLCQPXLPXPXCQXVLHQIL

SEQ ID NO: 335021 - protein, 14 aa, Artificial Sequence
  Description of Artificial Sequence: Synthetic peptide
  Seed: QPVLPSPACQLVLH (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLH

SEQ ID NO: 335022 - protein, 15 aa, Artificial Sequence
  Description of Artificial Sequence: Synthetic peptide
  Seed: QPVLPSPACQLVLHQ (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQ

SEQ ID NO: 335023 - protein, 16 aa, Artificial Sequence
  Description of Artificial Sequence: Synthetic peptide
  Seed: QPVLPSPACQLVLHQI (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQI

SEQ ID NO: 335024 - protein, 17 aa, Artificial Sequence
  Description of Artificial Sequence: Synthetic peptide
  Seed: QPVLPSPACQLVLHQIL (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQIL

SEQ ID NO: 335025 - protein, 18 aa, Artificial Sequence
  Description of Artificial Sequence: Synthetic peptide
  Seed: QPVLPSPACQLVLHQILK (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQILK

SEQ ID NO: 335026 - protein, 18 aa, Artificial Sequence
  Description of Artificial Sequence: Synthetic peptide
  Seed: QPVLPSPACQLVLHQILK (PMEL_HUMAN)
  Core: CQLVLHQIL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPAXQLXLXQIXK

SEQ ID NO: 335027 - protein, 19 aa, Artificial Sequence
  Description of Artificial Sequence: Synthetic peptide
  Seed: QPVLPSPACQLVLHQILKG (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQILKG

SEQ ID NO: 335028 - protein, 19 aa, Artificial Sequence
  Description of Artificial Sequence: Synthetic peptide
  Seed: QPVLPSPACQLVLHQILKG (PMEL_HUMAN)
  Core: PACQLVLHQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSXACXLXLHXILKG

SEQ ID NO: 335029 - protein, 19 aa, Artificial Sequence
  Description of Artificial Sequence: Synthetic peptide
  Seed: QPVLPSPACQLVLHQILKG (PMEL_HUMAN)
  Core: ACQLVLHQI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPXCQXVXHQXLKG

SEQ ID NO: 335030 - protein, 19 aa, Artificial Sequence
  Description of Artificial Sequence: Synthetic peptide
  Seed: QPVLPSPACQLVLHQILKG (PMEL_HUMAN)
  Core: CQLVLHQIL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPAXQLXLXQIXKG

SEQ ID NO: 335031 - protein, 19 aa, Artificial Sequence
  Description of Artificial Sequence: Synthetic peptide
  Seed: QPVLPSPACQLVLHQILKG (PMEL_HUMAN)
  Core: LVLHQILKG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQXVLXQXLKX

SEQ ID NO: 335032 - protein, 20 aa, Artificial Sequence
  Description of Artificial Sequence: Synthetic peptide
  Seed: QPVLPSPACQLVLHQILKGG (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQILKGG

SEQ ID NO: 335033 - protein, 20 aa, Artificial Sequence
  Description of Artificial Sequence: Synthetic peptide
  Seed: QPVLPSPACQLVLHQILKGG (PMEL_HUMAN)
  Core: ACQLVLHQI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPXCQXVXHQXLKGG

SEQ ID NO: 335034 - protein, 20 aa, Artificial Sequence
  Description of Artificial Sequence: Synthetic peptide
  Seed: QPVLPSPACQLVLHQILKGG (PMEL_HUMAN)
  Core: CQLVLHQIL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPAXQLXLXQIXKGG

SEQ ID NO: 335035 - protein, 20 aa, Artificial Sequence
  Description of Artificial Sequence: Synthetic peptide
  Seed: QPVLPSPACQLVLHQILKGG (PMEL_HUMAN)
  Core: LVLHQILKG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQXVLXQXLKXG

SEQ ID NO: 335036 - protein, 21 aa, Artificial Sequence
  Description of Artificial Sequence: Synthetic peptide
  Seed: QPVLPSPACQLVLHQILKGGS (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQILKGGS

SEQ ID NO: 335037 - protein, 21 aa, Artificial Sequence
  Description of Artificial Sequence: Synthetic peptide
  Seed: QPVLPSPACQLVLHQILKGGS (PMEL_HUMAN)
  Core: CQLVLHQIL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPAXQLXLXQIXKGGS

SEQ ID NO: 335038 - protein, 21 aa, Artificial Sequence
  Description of Artificial Sequence: Synthetic peptide
  Seed: QPVLPSPACQLVLHQILKGGS (PMEL_HUMAN)
  Core: LVLHQILKG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQXVLXQXLKXGS

SEQ ID NO: 335039 - protein, 22 aa, Artificial Sequence
  Description of Artificial Sequence: Synthetic peptide
  Seed: QPVLPSPACQLVLHQILKGGSG (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQILKGGSG

SEQ ID NO: 335040 - protein, 22 aa, Artificial Sequence
  Description of Artificial Sequence: Synthetic peptide
  Seed: QPVLPSPACQLVLHQILKGGSG (PMEL_HUMAN)
  Core: LVLHQILKG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQXVLXQXLKXGSG

SEQ ID NO: 335041 - protein, 22 aa, Artificial Sequence
  Description of Artificial Sequence: Synthetic peptide
  Seed: QPVLPSPACQLVLHQILKGGSG (PMEL_HUMAN)
  Core: LHQILKGGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQLVXHQXLXGGXG

SEQ ID NO: 335042 - protein, 23 aa, Artificial Sequence
  Description of Artificial Sequence: Synthetic peptide
  Seed: QPVLPSPACQLVLHQILKGGSGT (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQILKGGSGT

SEQ ID NO: 335043 - protein, 23 aa, Artificial Sequence
  Description of Artificial Sequence: Synthetic peptide
  Seed: QPVLPSPACQLVLHQILKGGSGT (PMEL_HUMAN)
  Core: LVLHQILKG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQXVLXQXLKXGSGT

SEQ ID NO: 335044 - protein, 23 aa, Artificial Sequence
  Description of Artificial Sequence: Synthetic peptide
  Seed: QPVLPSPACQLVLHQILKGGSGT (PMEL_HUMAN)
  Core: LHQILKGGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQLVXHQXLXGGXGT

SEQ ID NO: 335045 - protein, 24 aa, Artificial Sequence
  Description of Artificial Sequence: Synthetic peptide
  Seed: QPVLPSPACQLVLHQILKGGSGTY (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQILKGGSGTY

SEQ ID NO: 335046 - protein, 24 aa, Artificial Sequence
  Description of Artificial Sequence: Synthetic peptide
  Seed: QPVLPSPACQLVLHQILKGGSGTY (PMEL_HUMAN)
  Core: LVLHQILKG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQXVLXQXLKXGSGTY

SEQ ID NO: 335047 - protein, 24 aa, Artificial Sequence
  Description of Artificial Sequence: Synthetic peptide
  Seed: QPVLPSPACQLVLHQILKGGSGTY (PMEL_HUMAN)
  Core: LHQILKGGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQLVXHQXLXGGXGTY

SEQ ID NO: 335048 - protein, 25 aa, Artificial Sequence
  Description of Artificial Sequence: Synthetic peptide
  Seed: QPVLPSPACQLVLHQILKGGSGTYC (PMEL_HUMAN)
  Core: VLPSPACQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QPXLPXPXCQXVLHQILKGGSGTYC

SEQ ID NO: 335049 - protein, 25 aa, Artificial Sequence
  Description of Artificial Sequence: Synthetic peptide
  Seed: QPVLPSPACQLVLHQILKGGSGTYC (PMEL_HUMAN)
  Core: LVLHQILKG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQXVLXQXLKXGSGTYC

SEQ ID NO: 335050 - protein, 25 aa, Artificial Sequence
  Description of Artificial Sequence: Synthetic peptide
  Seed: QPVLPSPACQLVLHQILKGGSGTYC (PMEL_HUMAN)
  Core: LHQILKGGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QPVLPSPACQLVXHQXLXGGXGTYC

SEQ ID NO: 335051 - protein, 15 aa, Artificial Sequence
  Description of Artificial Sequence: Synthetic peptide
  Seed: QRLCQPVLPSPACQL (PMEL_HUMAN)
  Core: CQPVLPSPA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QRLXQPXLXSPXCQL

SEQ ID NO: 335052 - protein, 15 aa, Artificial Sequence
  Description of Artificial Sequence: Synthetic peptide
  Seed: QRLCQPVLPSPACQL (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQX

SEQ ID NO: 335053 - protein, 16 aa, Artificial Sequence
  Description of Artificial Sequence: Synthetic peptide
  Seed: QRLCQPVLPSPACQLV (PMEL_HUMAN)
  Core: CQPVLPSPA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QRLXQPXLXSPXCQLV

SEQ ID NO: 335054 - protein, 16 aa, Artificial Sequence
  Description of Artificial Sequence: Synthetic peptide
  Seed: QRLCQPVLPSPACQLV (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQXV

SEQ ID NO: 335055 - protein, 17 aa, Artificial Sequence
  Description of Artificial Sequence: Synthetic peptide
  Seed: QRLCQPVLPSPACQLVL (PMEL_HUMAN)
  Core: CQPVLPSPA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QRLXQPXLXSPXCQLVL

SEQ ID NO: 335056 - protein, 17 aa, Artificial Sequence
  Description of Artificial Sequence: Synthetic peptide
  Seed: QRLCQPVLPSPACQLVL (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQXVL

SEQ ID NO: 335057 - protein, 19 aa, Artificial Sequence
  Description of Artificial Sequence: Synthetic peptide
  Seed: QRLCQPVLPSPACQLVLHQ (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQXVLHQ

SEQ ID NO: 335058 - protein, 20 aa, Artificial Sequence
  Description of Artificial Sequence: Synthetic peptide
  Seed: QRLCQPVLPSPACQLVLHQI (PMEL_HUMAN)
  Core: CQPVLPSPA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QRLXQPXLXSPXCQLVLHQI

SEQ ID NO: 335059 - protein, 20 aa, Artificial Sequence
  Description of Artificial Sequence: Synthetic peptide
  Seed: QRLCQPVLPSPACQLVLHQI (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQXVLHQI

SEQ ID NO: 335060 - protein, 21 aa, Artificial Sequence
  Description of Artificial Sequence: Synthetic peptide
  Seed: QRLCQPVLPSPACQLVLHQIL (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQXVLHQIL

SEQ ID NO: 335061 - protein, 22 aa, Artificial Sequence
  Description of Artificial Sequence: Synthetic peptide
  Seed: QRLCQPVLPSPACQLVLHQILK (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQXVLHQILK

SEQ ID NO: 335062 - protein, 22 aa, Artificial Sequence
  Description of Artificial Sequence: Synthetic peptide
  Seed: QRLCQPVLPSPACQLVLHQILK (PMEL_HUMAN)
  Core: PACQLVLHQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSXACXLXLHXILK

SEQ ID NO: 335063 - protein, 22 aa, Artificial Sequence
  Description of Artificial Sequence: Synthetic peptide
  Seed: QRLCQPVLPSPACQLVLHQILK (PMEL_HUMAN)
  Core: CQLVLHQIL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSPAXQLXLXQIXK

SEQ ID NO: 335064 - protein, 23 aa, Artificial Sequence
  Description of Artificial Sequence: Synthetic peptide
  Seed: QRLCQPVLPSPACQLVLHQILKG (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQXVLHQILKG

SEQ ID NO: 335065 - protein, 23 aa, Artificial Sequence
  Description of Artificial Sequence: Synthetic peptide
  Seed: QRLCQPVLPSPACQLVLHQILKG (PMEL_HUMAN)
  Core: PACQLVLHQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSXACXLXLHXILKG

SEQ ID NO: 335066 - protein, 23 aa, Artificial Sequence
  Description of Artificial Sequence: Synthetic peptide
  Seed: QRLCQPVLPSPACQLVLHQILKG (PMEL_HUMAN)
  Core: ACQLVLHQI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSPXCQXVXHQXLKG

SEQ ID NO: 335067 - protein, 23 aa, Artificial Sequence
  Description of Artificial Sequence: Synthetic peptide
  Seed: QRLCQPVLPSPACQLVLHQILKG (PMEL_HUMAN)
  Core: CQLVLHQIL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSPAXQLXLXQIXKG

SEQ ID NO: 335068 - protein, 23 aa, Artificial Sequence
  Description of Artificial Sequence: Synthetic peptide
  Seed: QRLCQPVLPSPACQLVLHQILKG (PMEL_HUMAN)
  Core: LVLHQILKG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSPACQXVLXQXLKX

SEQ ID NO: 335069 - protein, 24 aa, Artificial Sequence
  Description of Artificial Sequence: Synthetic peptide
  Seed: QRLCQPVLPSPACQLVLHQILKGG (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQXVLHQILKGG

SEQ ID NO: 335070 - protein, 24 aa, Artificial Sequence
  Description of Artificial Sequence: Synthetic peptide
  Seed: QRLCQPVLPSPACQLVLHQILKGG (PMEL_HUMAN)
  Core: CQLVLHQIL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSPAXQLXLXQIXKGG

SEQ ID NO: 335071 - protein, 24 aa, Artificial Sequence
  Description of Artificial Sequence: Synthetic peptide
  Seed: QRLCQPVLPSPACQLVLHQILKGG (PMEL_HUMAN)
  Core: LVLHQILKG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSPACQXVLXQXLKXG

SEQ ID NO: 335072 - protein, 25 aa, Artificial Sequence
  Description of Artificial Sequence: Synthetic peptide
  Seed: QRLCQPVLPSPACQLVLHQILKGGS (PMEL_HUMAN)
  Core: CQPVLPSPA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QRLXQPXLXSPXCQLVLHQILKGGS

SEQ ID NO: 335073 - protein, 25 aa, Artificial Sequence
  Description of Artificial Sequence: Synthetic peptide
  Seed: QRLCQPVLPSPACQLVLHQILKGGS (PMEL_HUMAN)
  Core: VLPSPACQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPXLPXPXCQXVLHQILKGGS

SEQ ID NO: 335074 - protein, 25 aa, Artificial Sequence
  Description of Artificial Sequence: Synthetic peptide
  Seed: QRLCQPVLPSPACQLVLHQILKGGS (PMEL_HUMAN)
  Core: CQLVLHQIL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSPAXQLXLXQIXKGGS

SEQ ID NO: 335075 - protein, 25 aa, Artificial Sequence
  Description of Artificial Sequence: Synthetic peptide
  Seed: QRLCQPVLPSPACQLVLHQILKGGS (PMEL_HUMAN)
  Core: LVLHQILKG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QRLCQPVLPSPACQXVLXQXLKXGS

SEQ ID NO: 335076 - protein, 14 aa, Artificial Sequence
  Description of Artificial Sequence: Synthetic peptide
  Seed: QRLDCWRGGQVSLK (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLX

SEQ ID NO: 335077 - protein, 15 aa, Artificial Sequence
  Description of Artificial Sequence: Synthetic peptide
  Seed: QRLDCWRGGQVSLKV (PMEL_HUMAN)
  Core: LDCWRGGQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QRXDCXRXGQXSLKV

SEQ ID NO: 335078 - protein, 15 aa, Artificial Sequence
  Description of Artificial Sequence: Synthetic peptide
  Seed: QRLDCWRGGQVSLKV (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXV

SEQ ID NO: 335079 - protein, 16 aa, Artificial Sequence
  Description of Artificial Sequence: Synthetic peptide
  Seed: QRLDCWRGGQVSLKVS (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVS

SEQ ID NO: 335080 - protein, 17 aa, Artificial Sequence
  Description of Artificial Sequence: Synthetic peptide
  Seed: QRLDCWRGGQVSLKVSN (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVSN

SEQ ID NO: 335081 - protein, 18 aa, Artificial Sequence
  Description of Artificial Sequence: Synthetic peptide
  Seed: QRLDCWRGGQVSLKVSND (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVSND

SEQ ID NO: 335082 - protein, 19 aa, Artificial Sequence
  Description of Artificial Sequence: Synthetic peptide
  Seed: QRLDCWRGGQVSLKVSNDG (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVSNDG

SEQ ID NO: 335083 - protein, 20 aa, Artificial Sequence
  Description of Artificial Sequence: Synthetic peptide
  Seed: QRLDCWRGGQVSLKVSNDGP (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVSNDGP

SEQ ID NO: 335084 - protein, 21 aa, Artificial Sequence
  Description of Artificial Sequence: Synthetic peptide
  Seed: QRLDCWRGGQVSLKVSNDGPT (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVSNDGPT

SEQ ID NO: 335085 - protein, 22 aa, Artificial Sequence
  Description of Artificial Sequence: Synthetic peptide
  Seed: QRLDCWRGGQVSLKVSNDGPTL (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVSNDGPTL

SEQ ID NO: 335086 - protein, 23 aa, Artificial Sequence
  Description of Artificial Sequence: Synthetic peptide
  Seed: QRLDCWRGGQVSLKVSNDGPTLI (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVSNDGPTLI

SEQ ID NO: 335087 - protein, 23 aa, Artificial Sequence
  Description of Artificial Sequence: Synthetic peptide
  Seed: QRLDCWRGGQVSLKVSNDGPTLI (PMEL_HUMAN)
  Core: QVSLKVSND
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCWRGGXVSXKXSNXGPTLI

SEQ ID NO: 335088 - protein, 24 aa, Artificial Sequence
  Description of Artificial Sequence: Synthetic peptide
  Seed: QRLDCWRGGQVSLKVSNDGPTLIG (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVSNDGPTLIG

SEQ ID NO: 335089 - protein, 24 aa, Artificial Sequence
  Description of Artificial Sequence: Synthetic peptide
  Seed: QRLDCWRGGQVSLKVSNDGPTLIG (PMEL_HUMAN)
  Core: QVSLKVSND
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCWRGGXVSXKXSNXGPTLIG

SEQ ID NO: 335090 - protein, 24 aa, Artificial Sequence
  Description of Artificial Sequence: Synthetic peptide
  Seed: QRLDCWRGGQVSLKVSNDGPTLIG (PMEL_HUMAN)
  Core: LKVSNDGPT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCWRGGQVSXKVXNXGPXLIG

SEQ ID NO: 335091 - protein, 25 aa, Artificial Sequence
  Description of Artificial Sequence: Synthetic peptide
  Seed: QRLDCWRGGQVSLKVSNDGPTLIGA (PMEL_HUMAN)
  Core: WRGGQVSLK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCXRGXQXSLXVSNDGPTLIGA

SEQ ID NO: 335092 - protein, 25 aa, Artificial Sequence
  Description of Artificial Sequence: Synthetic peptide
  Seed: QRLDCWRGGQVSLKVSNDGPTLIGA (PMEL_HUMAN)
  Core: QVSLKVSND
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCWRGGXVSXKXSNXGPTLIGA

SEQ ID NO: 335093 - protein, 25 aa, Artificial Sequence
  Description of Artificial Sequence: Synthetic peptide
  Seed: QRLDCWRGGQVSLKVSNDGPTLIGA (PMEL_HUMAN)
  Core: VSNDGPTLI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QRLDCWRGGQVSLKXSNXGXTLXGA

SEQ ID NO: 335094 - protein, 13 aa, Artificial Sequence
  Description of Artificial Sequence: Synthetic peptide
  Seed: QVIWVNNTIINGS (PMEL_HUMAN)
  Core: VIWVNNTII
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXIWXNXTIXNGS

SEQ ID NO: 335095 - protein, 13 aa, Artificial Sequence
  Description of Artificial Sequence: Synthetic peptide
  Seed: QVIWVNNTIINGS (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGS

SEQ ID NO: 335096 - protein, 13 aa, Artificial Sequence
  Description of Artificial Sequence: Synthetic peptide
  Seed: QVIWVNNTIINGS (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXS

SEQ ID NO: 335097 - protein, 14 aa, Artificial Sequence
  Description of Artificial Sequence: Synthetic peptide
  Seed: QVIWVNNTIINGSQ (PMEL_HUMAN)
  Core: VIWVNNTII
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXIWXNXTIXNGSQ

SEQ ID NO: 335098 - protein, 14 aa, Artificial Sequence
  Description of Artificial Sequence: Synthetic peptide
  Seed: QVIWVNNTIINGSQ (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQ

SEQ ID NO: 335099 - protein, 14 aa, Artificial Sequence
  Description of Artificial Sequence: Synthetic peptide
  Seed: QVIWVNNTIINGSQ (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXSQ

SEQ ID NO: 335100 - protein, 14 aa, Artificial Sequence
  Description of Artificial Sequence: Synthetic peptide
  Seed: QVIWVNNTIINGSQ (PMEL_HUMAN)
  Core: VNNTIINGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVIWXNNXIXNGXQ

SEQ ID NO: 335101 - protein, 15 aa, Artificial Sequence
  Description of Artificial Sequence: Synthetic peptide
  Seed: QVIWVNNTIINGSQV (PMEL_HUMAN)
  Core: VIWVNNTII
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXIWXNXTIXNGSQV

SEQ ID NO: 335102 - protein, 15 aa, Artificial Sequence
  Description of Artificial Sequence: Synthetic peptide
  Seed: QVIWVNNTIINGSQV (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQV

SEQ ID NO: 335103 - protein, 15 aa, Artificial Sequence
  Description of Artificial Sequence: Synthetic peptide
  Seed: QVIWVNNTIINGSQV (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXSQV

SEQ ID NO: 335104 - protein, 15 aa, Artificial Sequence
  Description of Artificial Sequence: Synthetic peptide
  Seed: QVIWVNNTIINGSQV (PMEL_HUMAN)
  Core: VNNTIINGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVIWXNNXIXNGXQV

SEQ ID NO: 335105 - protein, 16 aa, Artificial Sequence
  Description of Artificial Sequence: Synthetic peptide
  Seed: QVIWVNNTIINGSQVW (PMEL_HUMAN)
  Core: VIWVNNTII
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXIWXNXTIXNGSQVW

SEQ ID NO: 335106 - protein, 16 aa, Artificial Sequence
  Description of Artificial Sequence: Synthetic peptide
  Seed: QVIWVNNTIINGSQVW (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVW

SEQ ID NO: 335107 - protein, 16 aa, Artificial Sequence
  Description of Artificial Sequence: Synthetic peptide
  Seed: QVIWVNNTIINGSQVW (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXSQVW

SEQ ID NO: 335108 - protein, 16 aa, Artificial Sequence
  Description of Artificial Sequence: Synthetic peptide
  Seed: QVIWVNNTIINGSQVW (PMEL_HUMAN)
  Core: VNNTIINGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVIWXNNXIXNGXQVW

SEQ ID NO: 335109 - protein, 17 aa, Artificial Sequence
  Description of Artificial Sequence: Synthetic peptide
  Seed: QVIWVNNTIINGSQVWG (PMEL_HUMAN)
  Core: VIWVNNTII
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXIWXNXTIXNGSQVWG

SEQ ID NO: 335110 - protein, 17 aa, Artificial Sequence
  Description of Artificial Sequence: Synthetic peptide
  Seed: QVIWVNNTIINGSQVWG (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVWG

SEQ ID NO: 335111 - protein, 17 aa, Artificial Sequence
  Description of Artificial Sequence: Synthetic peptide
  Seed: QVIWVNNTIINGSQVWG (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXSQVWG

SEQ ID NO: 335112 - protein, 17 aa, Artificial Sequence
  Description of Artificial Sequence: Synthetic peptide
  Seed: QVIWVNNTIINGSQVWG (PMEL_HUMAN)
  Core: VNNTIINGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVIWXNNXIXNGXQVWG

SEQ ID NO: 335113 - protein, 18 aa, Artificial Sequence
  Description of Artificial Sequence: Synthetic peptide
  Seed: QVIWVNNTIINGSQVWGG (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVWGG

SEQ ID NO: 335114 - protein, 18 aa, Artificial Sequence
  Description of Artificial Sequence: Synthetic peptide
  Seed: QVIWVNNTIINGSQVWGG (PMEL_HUMAN)
  Core: NTIINGSQV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNXTIXNXSQXWGG

SEQ ID NO: 335115 - protein, 18 aa, Artificial Sequence
  Description of Artificial Sequence: Synthetic peptide
  Seed: QVIWVNNTIINGSQVWGG (PMEL_HUMAN)
  Core: INGSQVWGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIXNGXQXWGX

SEQ ID NO: 335116 - protein, 19 aa, Artificial Sequence
  Description of Artificial Sequence: Synthetic peptide
  Seed: QVIWVNNTIINGSQVWGGQ (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVWGGQ

SEQ ID NO: 335117 - protein, 19 aa, Artificial Sequence
  Description of Artificial Sequence: Synthetic peptide
  Seed: QVIWVNNTIINGSQVWGGQ (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXSQVWGGQ

SEQ ID NO: 335118 - protein, 19 aa, Artificial Sequence
  Description of Artificial Sequence: Synthetic peptide
  Seed: QVIWVNNTIINGSQVWGGQ (PMEL_HUMAN)
  Core: INGSQVWGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIXNGXQXWGXQ

SEQ ID NO: 335119 - protein, 20 aa, Artificial Sequence
  Description of Artificial Sequence: Synthetic peptide
  Seed: QVIWVNNTIINGSQVWGGQP (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVWGGQP

SEQ ID NO: 335120 - protein, 20 aa, Artificial Sequence
  Description of Artificial Sequence: Synthetic peptide
  Seed: QVIWVNNTIINGSQVWGGQP (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXSQVWGGQP

SEQ ID NO: 335121 - protein, 20 aa, Artificial Sequence
  Description of Artificial Sequence: Synthetic peptide
  Seed: QVIWVNNTIINGSQVWGGQP (PMEL_HUMAN)
  Core: INGSQVWGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIXNGXQXWGXQP

SEQ ID NO: 335122 - protein, 21 aa, Artificial Sequence
  Description of Artificial Sequence: Synthetic peptide
  Seed: QVIWVNNTIINGSQVWGGQPV (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVWGGQPV

SEQ ID NO: 335123 - protein, 21 aa, Artificial Sequence
  Description of Artificial Sequence: Synthetic peptide
  Seed: QVIWVNNTIINGSQVWGGQPV (PMEL_HUMAN)
  Core: INGSQVWGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIXNGXQXWGXQPV

SEQ ID NO: 335124 - protein, 22 aa, Artificial Sequence
  Description of Artificial Sequence: Synthetic peptide
  Seed: QVIWVNNTIINGSQVWGGQPVY (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVWGGQPVY

SEQ ID NO: 335125 - protein, 22 aa, Artificial Sequence
  Description of Artificial Sequence: Synthetic peptide
  Seed: QVIWVNNTIINGSQVWGGQPVY (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXSQVWGGQPVY

SEQ ID NO: 335126 - protein, 22 aa, Artificial Sequence
  Description of Artificial Sequence: Synthetic peptide
  Seed: QVIWVNNTIINGSQVWGGQPVY (PMEL_HUMAN)
  Core: INGSQVWGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIXNGXQXWGXQPVY

SEQ ID NO: 335127 - protein, 23 aa, Artificial Sequence
  Description of Artificial Sequence: Synthetic peptide
  Seed: QVIWVNNTIINGSQVWGGQPVYP (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVWGGQPVYP

SEQ ID NO: 335128 - protein, 23 aa, Artificial Sequence
  Description of Artificial Sequence: Synthetic peptide
  Seed: QVIWVNNTIINGSQVWGGQPVYP (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXSQVWGGQPVYP

SEQ ID NO: 335129 - protein, 23 aa, Artificial Sequence
  Description of Artificial Sequence: Synthetic peptide
  Seed: QVIWVNNTIINGSQVWGGQPVYP (PMEL_HUMAN)
  Core: INGSQVWGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIXNGXQXWGXQPVYP

SEQ ID NO: 335130 - protein, 24 aa, Artificial Sequence
  Description of Artificial Sequence: Synthetic peptide
  Seed: QVIWVNNTIINGSQVWGGQPVYPQ (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVWGGQPVYPQ

SEQ ID NO: 335131 - protein, 24 aa, Artificial Sequence
  Description of Artificial Sequence: Synthetic peptide
  Seed: QVIWVNNTIINGSQVWGGQPVYPQ (PMEL_HUMAN)
  Core: WVNNTIING
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVIXVNXTXINXSQVWGGQPVYPQ

SEQ ID NO: 335132 - protein, 24 aa, Artificial Sequence
  Description of Artificial Sequence: Synthetic peptide
  Seed: QVIWVNNTIINGSQVWGGQPVYPQ (PMEL_HUMAN)
  Core: INGSQVWGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIXNGXQXWGXQPVYPQ

SEQ ID NO: 335133 - protein, 24 aa, Artificial Sequence
  Description of Artificial Sequence: Synthetic peptide
  Seed: QVIWVNNTIINGSQVWGGQPVYPQ (PMEL_HUMAN)
  Core: SQVWGGQPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIINGXQVXGXQPXYPQ

SEQ ID NO: 335134 - protein, 25 aa, Artificial Sequence
  Description of Artificial Sequence: Synthetic peptide
  Seed: QVIWVNNTIINGSQVWGGQPVYPQE (PMEL_HUMAN)
  Core: IWVNNTIIN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXWVXNXIIXGSQVWGGQPVYPQE

SEQ ID NO: 335135 - protein, 25 aa, Artificial Sequence
  Description of Artificial Sequence: Synthetic peptide
  Seed: QVIWVNNTIINGSQVWGGQPVYPQE (PMEL_HUMAN)
  Core: INGSQVWGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIXNGXQXWGXQPVYPQE

SEQ ID NO: 335136 - protein, 25 aa, Artificial Sequence
  Description of Artificial Sequence: Synthetic peptide
  Seed: QVIWVNNTIINGSQVWGGQPVYPQE (PMEL_HUMAN)
  Core: SQVWGGQPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVIWVNNTIINGXQVXGXQPXYPQE

SEQ ID NO: 335137 - protein, 13 aa, Artificial Sequence
  Description of Artificial Sequence: Synthetic peptide
  Seed: QVLGGPVSGLSIG (PMEL_HUMAN)
  Core: VLGGPVSGL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXLGXPXSGXSIG

SEQ ID NO: 335138 - protein, 14 aa, Artificial Sequence
  Description of Artificial Sequence: Synthetic peptide
  Seed: QVLGGPVSGLSIGT (PMEL_HUMAN)
  Core: PVSGLSIGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGXVSXLXIGX

SEQ ID NO: 335139 - protein, 15 aa, Artificial Sequence
  Description of Artificial Sequence: Synthetic peptide
  Seed: QVLGGPVSGLSIGTG (PMEL_HUMAN)
  Core: PVSGLSIGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGXVSXLXIGXG

SEQ ID NO: 335140 - protein, 15 aa, Artificial Sequence
  Description of Artificial Sequence: Synthetic peptide
  Seed: QVLGGPVSGLSIGTG (PMEL_HUMAN)
  Core: VSGLSIGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPXSGXSXGTX

SEQ ID NO: 335141 - protein, 16 aa, Artificial Sequence
  Description of Artificial Sequence: Synthetic peptide
  Seed: QVLGGPVSGLSIGTGR (PMEL_HUMAN)
  Core: PVSGLSIGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGXVSXLXIGXGR

SEQ ID NO: 335142 - protein, 16 aa, Artificial Sequence
  Description of Artificial Sequence: Synthetic peptide
  Seed: QVLGGPVSGLSIGTGR (PMEL_HUMAN)
  Core: VSGLSIGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPXSGXSXGTXR

SEQ ID NO: 335143 - protein, 17 aa, Artificial Sequence
  Description of Artificial Sequence: Synthetic peptide
  Seed: QVLGGPVSGLSIGTGRA (PMEL_HUMAN)
  Core: PVSGLSIGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGXVSXLXIGXGRA

SEQ ID NO: 335144 - protein, 17 aa, Artificial Sequence
  Description of Artificial Sequence: Synthetic peptide
  Seed: QVLGGPVSGLSIGTGRA (PMEL_HUMAN)
  Core: VSGLSIGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPXSGXSXGTXRA

SEQ ID NO: 335145 - protein, 18 aa, Artificial Sequence
  Description of Artificial Sequence: Synthetic peptide
  Seed: QVLGGPVSGLSIGTGRAM (PMEL_HUMAN)
  Core: PVSGLSIGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGXVSXLXIGXGRAM

SEQ ID NO: 335146 - protein, 19 aa, Artificial Sequence
  Description of Artificial Sequence: Synthetic peptide
  Seed: QVLGGPVSGLSIGTGRAML (PMEL_HUMAN)
  Core: PVSGLSIGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGXVSXLXIGXGRAML

SEQ ID NO: 335147 - protein, 19 aa, Artificial Sequence
  Description of Artificial Sequence: Synthetic peptide
  Seed: QVLGGPVSGLSIGTGRAML (PMEL_HUMAN)
  Core: VSGLSIGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPXSGXSXGTXRAML

SEQ ID NO: 335148 - protein, 19 aa, Artificial Sequence
  Description of Artificial Sequence: Synthetic peptide
  Seed: QVLGGPVSGLSIGTGRAML (PMEL_HUMAN)
  Core: LSIGTGRAM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGXSIXTXRAXL

SEQ ID NO: 335149 - protein, 20 aa, Artificial Sequence
  Description of Artificial Sequence: Synthetic peptide
  Seed: QVLGGPVSGLSIGTGRAMLG (PMEL_HUMAN)
  Core: PVSGLSIGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGXVSXLXIGXGRAMLG

SEQ ID NO: 335150 - protein, 20 aa, Artificial Sequence
  Description of Artificial Sequence: Synthetic peptide
  Seed: QVLGGPVSGLSIGTGRAMLG (PMEL_HUMAN)
  Core: VSGLSIGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPXSGXSXGTXRAMLG

SEQ ID NO: 335151 - protein, 20 aa, Artificial Sequence
  Description of Artificial Sequence: Synthetic peptide
  Seed: QVLGGPVSGLSIGTGRAMLG (PMEL_HUMAN)
  Core: LSIGTGRAM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGXSIXTXRAXLG

SEQ ID NO: 335152 - protein, 21 aa, Artificial Sequence
  Description of Artificial Sequence: Synthetic peptide
  Seed: QVLGGPVSGLSIGTGRAMLGT (PMEL_HUMAN)
  Core: PVSGLSIGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGXVSXLXIGXGRAMLGT

SEQ ID NO: 335153 - protein, 21 aa, Artificial Sequence
  Description of Artificial Sequence: Synthetic peptide
  Seed: QVLGGPVSGLSIGTGRAMLGT (PMEL_HUMAN)
  Core: VSGLSIGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPXSGXSXGTXRAMLGT

SEQ ID NO: 335154 - protein, 21 aa, Artificial Sequence
  Description of Artificial Sequence: Synthetic peptide
  Seed: QVLGGPVSGLSIGTGRAMLGT (PMEL_HUMAN)
  Core: LSIGTGRAM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGXSIXTXRAXLGT

SEQ ID NO: 335155 - protein, 21 aa, Artificial Sequence
  Description of Artificial Sequence: Synthetic peptide
  Seed: QVLGGPVSGLSIGTGRAMLGT (PMEL_HUMAN)
  Core: IGTGRAMLG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGLSXGTXRXMLXT

SEQ ID NO: 335156 - protein, 22 aa, Artificial Sequence
  Description of Artificial Sequence: Synthetic peptide
  Seed: QVLGGPVSGLSIGTGRAMLGTH (PMEL_HUMAN)
  Core: VSGLSIGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPXSGXSXGTXRAMLGTH

SEQ ID NO: 335157 - protein, 22 aa, Artificial Sequence
  Description of Artificial Sequence: Synthetic peptide
  Seed: QVLGGPVSGLSIGTGRAMLGTH (PMEL_HUMAN)
  Core: LSIGTGRAM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGXSIXTXRAXLGTH

SEQ ID NO: 335158 - protein, 22 aa, Artificial Sequence
  Description of Artificial Sequence: Synthetic peptide
  Seed: QVLGGPVSGLSIGTGRAMLGTH (PMEL_HUMAN)
  Core: IGTGRAMLG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGLSXGTXRXMLXTH

SEQ ID NO: 335159 - protein, 23 aa, Artificial Sequence
  Description of Artificial Sequence: Synthetic peptide
  Seed: QVLGGPVSGLSIGTGRAMLGTHT (PMEL_HUMAN)
  Core: LSIGTGRAM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGXSIXTXRAXLGTHT

SEQ ID NO: 335160 - protein, 23 aa, Artificial Sequence
  Description of Artificial Sequence: Synthetic peptide
  Seed: QVLGGPVSGLSIGTGRAMLGTHT (PMEL_HUMAN)
  Core: IGTGRAMLG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGLSXGTXRXMLXTHT

SEQ ID NO: 335161 - protein, 24 aa, Artificial Sequence
  Description of Artificial Sequence: Synthetic peptide
  Seed: QVLGGPVSGLSIGTGRAMLGTHTM (PMEL_HUMAN)
  Core: VSGLSIGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPXSGXSXGTXRAMLGTHTM

SEQ ID NO: 335162 - protein, 24 aa, Artificial Sequence
  Description of Artificial Sequence: Synthetic peptide
  Seed: QVLGGPVSGLSIGTGRAMLGTHTM (PMEL_HUMAN)
  Core: LSIGTGRAM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGXSIXTXRAXLGTHTM

SEQ ID NO: 335163 - protein, 24 aa, Artificial Sequence
  Description of Artificial Sequence: Synthetic peptide
  Seed: QVLGGPVSGLSIGTGRAMLGTHTM (PMEL_HUMAN)
  Core: IGTGRAMLG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGLSXGTXRXMLXTHTM

SEQ ID NO: 335164 - protein, 25 aa, Artificial Sequence
  Description of Artificial Sequence: Synthetic peptide
  Seed: QVLGGPVSGLSIGTGRAMLGTHTME (PMEL_HUMAN)
  Core: VSGLSIGTG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPXSGXSXGTXRAMLGTHTME

SEQ ID NO: 335165 - protein, 25 aa, Artificial Sequence
  Description of Artificial Sequence: Synthetic peptide
  Seed: QVLGGPVSGLSIGTGRAMLGTHTME (PMEL_HUMAN)
  Core: LSIGTGRAM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGXSIXTXRAXLGTHTME

SEQ ID NO: 335166 - protein, 25 aa, Artificial Sequence
  Description of Artificial Sequence: Synthetic peptide
  Seed: QVLGGPVSGLSIGTGRAMLGTHTME (PMEL_HUMAN)
  Core: IGTGRAMLG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVLGGPVSGLSXGTXRXMLXTHTME

SEQ ID NO: 335167 - protein, 14 aa, Artificial Sequence
  Description of Artificial Sequence: Synthetic peptide
  Seed: QVPFSVSVSQLRAL (PMEL_HUMAN)
  Core: PFSVSVSQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXFSXSXSQXRAL

SEQ ID NO: 335168 - protein, 14 aa, Artificial Sequence
  Description of Artificial Sequence: Synthetic peptide
  Seed: QVPFSVSVSQLRAL (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXAL

SEQ ID NO: 335169 - protein, 14 aa, Artificial Sequence
  Description of Artificial Sequence: Synthetic peptide
  Seed: QVPFSVSVSQLRAL (PMEL_HUMAN)
  Core: SVSVSQLRA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPFXVSXSXLRXL

SEQ ID NO: 335170 - protein, 14 aa, Artificial Sequence
  Description of Artificial Sequence: Synthetic peptide
  Seed: QVPFSVSVSQLRAL (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAX

SEQ ID NO: 335171 - protein, 15 aa, Artificial Sequence
  Description of Artificial Sequence: Synthetic peptide
  Seed: QVPFSVSVSQLRALD (PMEL_HUMAN)
  Core: PFSVSVSQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXFSXSXSQXRALD

SEQ ID NO: 335172 - protein, 15 aa, Artificial Sequence
  Description of Artificial Sequence: Synthetic peptide
  Seed: QVPFSVSVSQLRALD (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALD

SEQ ID NO: 335173 - protein, 15 aa, Artificial Sequence
  Description of Artificial Sequence: Synthetic peptide
  Seed: QVPFSVSVSQLRALD (PMEL_HUMAN)
  Core: SVSVSQLRA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPFXVSXSXLRXLD

SEQ ID NO: 335174 - protein, 15 aa, Artificial Sequence
  Description of Artificial Sequence: Synthetic peptide
  Seed: QVPFSVSVSQLRALD (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXD

SEQ ID NO: 335175 - protein, 16 aa, Artificial Sequence
  Description of Artificial Sequence: Synthetic peptide
  Seed: QVPFSVSVSQLRALDG (PMEL_HUMAN)
  Core: PFSVSVSQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXFSXSXSQXRALDG

SEQ ID NO: 335176 - protein, 16 aa, Artificial Sequence
  Description of Artificial Sequence: Synthetic peptide
  Seed: QVPFSVSVSQLRALDG (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALDG

SEQ ID NO: 335177 - protein, 16 aa, Artificial Sequence
  Description of Artificial Sequence: Synthetic peptide
  Seed: QVPFSVSVSQLRALDG (PMEL_HUMAN)
  Core: SVSVSQLRA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPFXVSXSXLRXLDG

SEQ ID NO: 335178 - protein, 16 aa, Artificial Sequence
  Description of Artificial Sequence: Synthetic peptide
  Seed: QVPFSVSVSQLRALDG (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDG

SEQ ID NO: 335179 - protein, 17 aa, Artificial Sequence
  Description of Artificial Sequence: Synthetic peptide
  Seed: QVPFSVSVSQLRALDGG (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALDGG

SEQ ID NO: 335180 - protein, 17 aa, Artificial Sequence
  Description of Artificial Sequence: Synthetic peptide
  Seed: QVPFSVSVSQLRALDGG (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDGG

SEQ ID NO: 335181 - protein, 17 aa, Artificial Sequence
  Description of Artificial Sequence: Synthetic peptide
  Seed: QVPFSVSVSQLRALDGG (PMEL_HUMAN)
  Core: VSQLRALDG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSXSQXRXLDXG

SEQ ID NO: 335182 - protein, 18 aa, Artificial Sequence
  Description of Artificial Sequence: Synthetic peptide
  Seed: QVPFSVSVSQLRALDGGN (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDGGN

SEQ ID NO: 335183 - protein, 19 aa, Artificial Sequence
  Description of Artificial Sequence: Synthetic peptide
  Seed: QVPFSVSVSQLRALDGGNK (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALDGGNK

SEQ ID NO: 335184 - protein, 19 aa, Artificial Sequence
  Description of Artificial Sequence: Synthetic peptide
  Seed: QVPFSVSVSQLRALDGGNK (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDGGNK

SEQ ID NO: 335185 - protein, 19 aa, Artificial Sequence
  Description of Artificial Sequence: Synthetic peptide
  Seed: QVPFSVSVSQLRALDGGNK (PMEL_HUMAN)
  Core: VSQLRALDG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSXSQXRXLDXGNK

SEQ ID NO: 335186 - protein, 20 aa, Artificial Sequence
  Description of Artificial Sequence: Synthetic peptide
  Seed: QVPFSVSVSQLRALDGGNKH (PMEL_HUMAN)
  Core: PFSVSVSQL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXFSXSXSQXRALDGGNKH

SEQ ID NO: 335187 - protein, 20 aa, Artificial Sequence
  Description of Artificial Sequence: Synthetic peptide
  Seed: QVPFSVSVSQLRALDGGNKH (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALDGGNKH

SEQ ID NO: 335188 - protein, 20 aa, Artificial Sequence
  Description of Artificial Sequence: Synthetic peptide
  Seed: QVPFSVSVSQLRALDGGNKH (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDGGNKH

SEQ ID NO: 335189 - protein, 20 aa, Artificial Sequence
  Description of Artificial Sequence: Synthetic peptide
  Seed: QVPFSVSVSQLRALDGGNKH (PMEL_HUMAN)
  Core: VSQLRALDG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSXSQXRXLDXGNKH

SEQ ID NO: 335190 - protein, 21 aa, Artificial Sequence
  Description of Artificial Sequence: Synthetic peptide
  Seed: QVPFSVSVSQLRALDGGNKHF (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALDGGNKHF

SEQ ID NO: 335191 - protein, 21 aa, Artificial Sequence
  Description of Artificial Sequence: Synthetic peptide
  Seed: QVPFSVSVSQLRALDGGNKHF (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDGGNKHF

SEQ ID NO: 335192 - protein, 21 aa, Artificial Sequence
  Description of Artificial Sequence: Synthetic peptide
  Seed: QVPFSVSVSQLRALDGGNKHF (PMEL_HUMAN)
  Core: VSQLRALDG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSXSQXRXLDXGNKHF

SEQ ID NO: 335193 - protein, 22 aa, Artificial Sequence
  Description of Artificial Sequence: Synthetic peptide
  Seed: QVPFSVSVSQLRALDGGNKHFL (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALDGGNKHFL

SEQ ID NO: 335194 - protein, 22 aa, Artificial Sequence
  Description of Artificial Sequence: Synthetic peptide
  Seed: QVPFSVSVSQLRALDGGNKHFL (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDGGNKHFL

SEQ ID NO: 335195 - protein, 22 aa, Artificial Sequence
  Description of Artificial Sequence: Synthetic peptide
  Seed: QVPFSVSVSQLRALDGGNKHFL (PMEL_HUMAN)
  Core: VSQLRALDG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSXSQXRXLDXGNKHFL

SEQ ID NO: 335196 - protein, 22 aa, Artificial Sequence
  Description of Artificial Sequence: Synthetic peptide
  Seed: QVPFSVSVSQLRALDGGNKHFL (PMEL_HUMAN)
  Core: LRALDGGNK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSVSQXRAXDXGNXHFL

SEQ ID NO: 335197 - protein, 23 aa, Artificial Sequence
  Description of Artificial Sequence: Synthetic peptide
  Seed: QVPFSVSVSQLRALDGGNKHFLR (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALDGGNKHFLR

SEQ ID NO: 335198 - protein, 23 aa, Artificial Sequence
  Description of Artificial Sequence: Synthetic peptide
  Seed: QVPFSVSVSQLRALDGGNKHFLR (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDGGNKHFLR

SEQ ID NO: 335199 - protein, 23 aa, Artificial Sequence
  Description of Artificial Sequence: Synthetic peptide
  Seed: QVPFSVSVSQLRALDGGNKHFLR (PMEL_HUMAN)
  Core: VSQLRALDG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSXSQXRXLDXGNKHFLR

SEQ ID NO: 335200 - protein, 23 aa, Artificial Sequence
  Description of Artificial Sequence: Synthetic peptide
  Seed: QVPFSVSVSQLRALDGGNKHFLR (PMEL_HUMAN)
  Core: LRALDGGNK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSVSQXRAXDXGNXHFLR

SEQ ID NO: 335201 - protein, 23 aa, Artificial Sequence
  Description of Artificial Sequence: Synthetic peptide
  Seed: QVPFSVSVSQLRALDGGNKHFLR (PMEL_HUMAN)
  Core: RALDGGNKH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSVSQLXALXGXNKXFLR

SEQ ID NO: 335202 - protein, 24 aa, Artificial Sequence
  Description of Artificial Sequence: Synthetic peptide
  Seed: QVPFSVSVSQLRALDGGNKHFLRN (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALDGGNKHFLRN

SEQ ID NO: 335203 - protein, 24 aa, Artificial Sequence
  Description of Artificial Sequence: Synthetic peptide
  Seed: QVPFSVSVSQLRALDGGNKHFLRN (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDGGNKHFLRN

SEQ ID NO: 335204 - protein, 24 aa, Artificial Sequence
  Description of Artificial Sequence: Synthetic peptide
  Seed: QVPFSVSVSQLRALDGGNKHFLRN (PMEL_HUMAN)
  Core: VSQLRALDG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSXSQXRXLDXGNKHFLRN

SEQ ID NO: 335205 - protein, 24 aa, Artificial Sequence
  Description of Artificial Sequence: Synthetic peptide
  Seed: QVPFSVSVSQLRALDGGNKHFLRN (PMEL_HUMAN)
  Core: LRALDGGNK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSVSQXRAXDXGNXHFLRN

SEQ ID NO: 335206 - protein, 24 aa, Artificial Sequence
  Description of Artificial Sequence: Synthetic peptide
  Seed: QVPFSVSVSQLRALDGGNKHFLRN (PMEL_HUMAN)
  Core: RALDGGNKH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSVSQLXALXGXNKXFLRN

SEQ ID NO: 335207 - protein, 25 aa, Artificial Sequence
  Description of Artificial Sequence: Synthetic peptide
  Seed: QVPFSVSVSQLRALDGGNKHFLRNQ (PMEL_HUMAN)
  Core: FSVSVSQLR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXSVXVXQLXALDGGNKHFLRNQ

SEQ ID NO: 335208 - protein, 25 aa, Artificial Sequence
  Description of Artificial Sequence: Synthetic peptide
  Seed: QVPFSVSVSQLRALDGGNKHFLRNQ (PMEL_HUMAN)
  Core: VSVSQLRAL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSXSVXQXRAXDGGNKHFLRNQ

SEQ ID NO: 335209 - protein, 25 aa, Artificial Sequence
  Description of Artificial Sequence: Synthetic peptide
  Seed: QVPFSVSVSQLRALDGGNKHFLRNQ (PMEL_HUMAN)
  Core: VSQLRALDG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSXSQXRXLDXGNKHFLRNQ

SEQ ID NO: 335210 - protein, 25 aa, Artificial Sequence
  Description of Artificial Sequence: Synthetic peptide
  Seed: QVPFSVSVSQLRALDGGNKHFLRNQ (PMEL_HUMAN)
  Core: LRALDGGNK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSVSQXRAXDXGNXHFLRNQ

SEQ ID NO: 335211 - protein, 25 aa, Artificial Sequence
  Description of Artificial Sequence: Synthetic peptide
  Seed: QVPFSVSVSQLRALDGGNKHFLRNQ (PMEL_HUMAN)
  Core: RALDGGNKH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSVSQLXALXGXNKXFLRNQ

SEQ ID NO: 335212 - protein, 25 aa, Artificial Sequence
  Description of Artificial Sequence: Synthetic peptide
  Seed: QVPFSVSVSQLRALDGGNKHFLRNQ (PMEL_HUMAN)
  Core: LDGGNKHFL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QVPFSVSVSQLRAXDGXNXHFXRNQ

SEQ ID NO: 335213 - protein, 14 aa, Artificial Sequence
  Description of Artificial Sequence: Synthetic peptide
  Seed: QVPLDCVLYRYGSF (PMEL_HUMAN)
  Core: LDCVLYRYG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXDCXLXRYXSF

SEQ ID NO: 335214 - protein, 15 aa, Artificial Sequence
  Description of Artificial Sequence: Synthetic peptide
  Seed: QVPLDCVLYRYGSFS (PMEL_HUMAN)
  Core: LDCVLYRYG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXDCXLXRYXSFS

SEQ ID NO: 335215 - protein, 16 aa, Artificial Sequence
  Description of Artificial Sequence: Synthetic peptide
  Seed: QVPLDCVLYRYGSFSV (PMEL_HUMAN)
  Core: LDCVLYRYG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXDCXLXRYXSFSV

SEQ ID NO: 335216 - protein, 16 aa, Artificial Sequence
  Description of Artificial Sequence: Synthetic peptide
  Seed: QVPLDCVLYRYGSFSV (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSX

SEQ ID NO: 335217 - protein, 17 aa, Artificial Sequence
  Description of Artificial Sequence: Synthetic peptide
  Seed: QVPLDCVLYRYGSFSVT (PMEL_HUMAN)
  Core: LDCVLYRYG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXDCXLXRYXSFSVT

SEQ ID NO: 335218 - protein, 17 aa, Artificial Sequence
  Description of Artificial Sequence: Synthetic peptide
  Seed: QVPLDCVLYRYGSFSVT (PMEL_HUMAN)
  Core: CVLYRYGSF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDXVLXRXGSXSVT

SEQ ID NO: 335219 - protein, 17 aa, Artificial Sequence
  Description of Artificial Sequence: Synthetic peptide
  Seed: QVPLDCVLYRYGSFSVT (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSXT

SEQ ID NO: 335220 - protein, 17 aa, Artificial Sequence
  Description of Artificial Sequence: Synthetic peptide
  Seed: QVPLDCVLYRYGSFSVT (PMEL_HUMAN)
  Core: YRYGSFSVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLXRYXSXSVX

SEQ ID NO: 335221 - protein, 18 aa, Artificial Sequence
  Description of Artificial Sequence: Synthetic peptide
  Seed: QVPLDCVLYRYGSFSVTL (PMEL_HUMAN)
  Core: LDCVLYRYG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXDCXLXRYXSFSVTL

SEQ ID NO: 335222 - protein, 18 aa, Artificial Sequence
  Description of Artificial Sequence: Synthetic peptide
  Seed: QVPLDCVLYRYGSFSVTL (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSXTL

SEQ ID NO: 335223 - protein, 18 aa, Artificial Sequence
  Description of Artificial Sequence: Synthetic peptide
  Seed: QVPLDCVLYRYGSFSVTL (PMEL_HUMAN)
  Core: YRYGSFSVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLXRYXSXSVXL

SEQ ID NO: 335224 - protein, 19 aa, Artificial Sequence
  Description of Artificial Sequence: Synthetic peptide
  Seed: QVPLDCVLYRYGSFSVTLD (PMEL_HUMAN)
  Core: LDCVLYRYG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXDCXLXRYXSFSVTLD

SEQ ID NO: 335225 - protein, 19 aa, Artificial Sequence
  Description of Artificial Sequence: Synthetic peptide
  Seed: QVPLDCVLYRYGSFSVTLD (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSXTLD

SEQ ID NO: 335226 - protein, 19 aa, Artificial Sequence
  Description of Artificial Sequence: Synthetic peptide
  Seed: QVPLDCVLYRYGSFSVTLD (PMEL_HUMAN)
  Core: YRYGSFSVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLXRYXSXSVXLD

SEQ ID NO: 335227 - protein, 19 aa, Artificial Sequence
  Description of Artificial Sequence: Synthetic peptide
  Seed: QVPLDCVLYRYGSFSVTLD (PMEL_HUMAN)
  Core: RYGSFSVTL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYXYGXFXVTXD

SEQ ID NO: 335228 - protein, 19 aa, Artificial Sequence
  Description of Artificial Sequence: Synthetic peptide
  Seed: QVPLDCVLYRYGSFSVTLD (PMEL_HUMAN)
  Core: YGSFSVTLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRXGSXSXTLX

SEQ ID NO: 335229 - protein, 20 aa, Artificial Sequence
  Description of Artificial Sequence: Synthetic peptide
  Seed: QVPLDCVLYRYGSFSVTLDI (PMEL_HUMAN)
  Core: CVLYRYGSF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDXVLXRXGSXSVTLDI

SEQ ID NO: 335230 - protein, 20 aa, Artificial Sequence
  Description of Artificial Sequence: Synthetic peptide
  Seed: QVPLDCVLYRYGSFSVTLDI (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSXTLDI

SEQ ID NO: 335231 - protein, 20 aa, Artificial Sequence
  Description of Artificial Sequence: Synthetic peptide
  Seed: QVPLDCVLYRYGSFSVTLDI (PMEL_HUMAN)
  Core: YRYGSFSVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLXRYXSXSVXLDI

SEQ ID NO: 335232 - protein, 20 aa, Artificial Sequence
  Description of Artificial Sequence: Synthetic peptide
  Seed: QVPLDCVLYRYGSFSVTLDI (PMEL_HUMAN)
  Core: RYGSFSVTL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYXYGXFXVTXDI

SEQ ID NO: 335233 - protein, 20 aa, Artificial Sequence
  Description of Artificial Sequence: Synthetic peptide
  Seed: QVPLDCVLYRYGSFSVTLDI (PMEL_HUMAN)
  Core: YGSFSVTLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRXGSXSXTLXI

SEQ ID NO: 335234 - protein, 21 aa, Artificial Sequence
  Description of Artificial Sequence: Synthetic peptide
  Seed: QVPLDCVLYRYGSFSVTLDIV (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSXTLDIV

SEQ ID NO: 335235 - protein, 21 aa, Artificial Sequence
  Description of Artificial Sequence: Synthetic peptide
  Seed: QVPLDCVLYRYGSFSVTLDIV (PMEL_HUMAN)
  Core: YRYGSFSVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLXRYXSXSVXLDIV

SEQ ID NO: 335236 - protein, 21 aa, Artificial Sequence
  Description of Artificial Sequence: Synthetic peptide
  Seed: QVPLDCVLYRYGSFSVTLDIV (PMEL_HUMAN)
  Core: RYGSFSVTL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYXYGXFXVTXDIV

SEQ ID NO: 335237 - protein, 21 aa, Artificial Sequence
  Description of Artificial Sequence: Synthetic peptide
  Seed: QVPLDCVLYRYGSFSVTLDIV (PMEL_HUMAN)
  Core: YGSFSVTLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRXGSXSXTLXIV

SEQ ID NO: 335238 - protein, 22 aa, Artificial Sequence
  Description of Artificial Sequence: Synthetic peptide
  Seed: QVPLDCVLYRYGSFSVTLDIVQ (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSXTLDIVQ

SEQ ID NO: 335239 - protein, 22 aa, Artificial Sequence
  Description of Artificial Sequence: Synthetic peptide
  Seed: QVPLDCVLYRYGSFSVTLDIVQ (PMEL_HUMAN)
  Core: YRYGSFSVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLXRYXSXSVXLDIVQ

SEQ ID NO: 335240 - protein, 22 aa, Artificial Sequence
  Description of Artificial Sequence: Synthetic peptide
  Seed: QVPLDCVLYRYGSFSVTLDIVQ (PMEL_HUMAN)
  Core: RYGSFSVTL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYXYGXFXVTXDIVQ

SEQ ID NO: 335241 - protein, 22 aa, Artificial Sequence
  Description of Artificial Sequence: Synthetic peptide
  Seed: QVPLDCVLYRYGSFSVTLDIVQ (PMEL_HUMAN)
  Core: YGSFSVTLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRXGSXSXTLXIVQ

SEQ ID NO: 335242 - protein, 22 aa, Artificial Sequence
  Description of Artificial Sequence: Synthetic peptide
  Seed: QVPLDCVLYRYGSFSVTLDIVQ (PMEL_HUMAN)
  Core: SFSVTLDIV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRYGXFSXTXDIXQ

SEQ ID NO: 335243 - protein, 23 aa, Artificial Sequence
  Description of Artificial Sequence: Synthetic peptide
  Seed: QVPLDCVLYRYGSFSVTLDIVQG (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSXTLDIVQG

SEQ ID NO: 335244 - protein, 23 aa, Artificial Sequence
  Description of Artificial Sequence: Synthetic peptide
  Seed: QVPLDCVLYRYGSFSVTLDIVQG (PMEL_HUMAN)
  Core: YRYGSFSVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLXRYXSXSVXLDIVQG

SEQ ID NO: 335245 - protein, 23 aa, Artificial Sequence
  Description of Artificial Sequence: Synthetic peptide
  Seed: QVPLDCVLYRYGSFSVTLDIVQG (PMEL_HUMAN)
  Core: RYGSFSVTL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYXYGXFXVTXDIVQG

SEQ ID NO: 335246 - protein, 23 aa, Artificial Sequence
  Description of Artificial Sequence: Synthetic peptide
  Seed: QVPLDCVLYRYGSFSVTLDIVQG (PMEL_HUMAN)
  Core: YGSFSVTLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRXGSXSXTLXIVQG

SEQ ID NO: 335247 - protein, 23 aa, Artificial Sequence
  Description of Artificial Sequence: Synthetic peptide
  Seed: QVPLDCVLYRYGSFSVTLDIVQG (PMEL_HUMAN)
  Core: SFSVTLDIV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRYGXFSXTXDIXQG

SEQ ID NO: 335248 - protein, 24 aa, Artificial Sequence
  Description of Artificial Sequence: Synthetic peptide
  Seed: QVPLDCVLYRYGSFSVTLDIVQGI (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSXTLDIVQGI

SEQ ID NO: 335249 - protein, 24 aa, Artificial Sequence
  Description of Artificial Sequence: Synthetic peptide
  Seed: QVPLDCVLYRYGSFSVTLDIVQGI (PMEL_HUMAN)
  Core: YRYGSFSVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLXRYXSXSVXLDIVQGI

SEQ ID NO: 335250 - protein, 24 aa, Artificial Sequence
  Description of Artificial Sequence: Synthetic peptide
  Seed: QVPLDCVLYRYGSFSVTLDIVQGI (PMEL_HUMAN)
  Core: RYGSFSVTL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYXYGXFXVTXDIVQGI

SEQ ID NO: 335251 - protein, 24 aa, Artificial Sequence
  Description of Artificial Sequence: Synthetic peptide
  Seed: QVPLDCVLYRYGSFSVTLDIVQGI (PMEL_HUMAN)
  Core: YGSFSVTLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRXGSXSXTLXIVQGI

SEQ ID NO: 335252 - protein, 24 aa, Artificial Sequence
  Description of Artificial Sequence: Synthetic peptide
  Seed: QVPLDCVLYRYGSFSVTLDIVQGI (PMEL_HUMAN)
  Core: SFSVTLDIV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRYGXFSXTXDIXQGI

SEQ ID NO: 335253 - protein, 25 aa, Artificial Sequence
  Description of Artificial Sequence: Synthetic peptide
  Seed: QVPLDCVLYRYGSFSVTLDIVQGIE (PMEL_HUMAN)
  Core: LYRYGSFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVXYRXGXFSXTLDIVQGIE

SEQ ID NO: 335254 - protein, 25 aa, Artificial Sequence
  Description of Artificial Sequence: Synthetic peptide
  Seed: QVPLDCVLYRYGSFSVTLDIVQGIE (PMEL_HUMAN)
  Core: YRYGSFSVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLXRYXSXSVXLDIVQGIE

SEQ ID NO: 335255 - protein, 25 aa, Artificial Sequence
  Description of Artificial Sequence: Synthetic peptide
  Seed: QVPLDCVLYRYGSFSVTLDIVQGIE (PMEL_HUMAN)
  Core: RYGSFSVTL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYXYGXFXVTXDIVQGIE

SEQ ID NO: 335256 - protein, 25 aa, Artificial Sequence
  Description of Artificial Sequence: Synthetic peptide
  Seed: QVPLDCVLYRYGSFSVTLDIVQGIE (PMEL_HUMAN)
  Core: YGSFSVTLD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRXGSXSXTLXIVQGIE

SEQ ID NO: 335257 - protein, 25 aa, Artificial Sequence
  Description of Artificial Sequence: Synthetic peptide
  Seed: QVPLDCVLYRYGSFSVTLDIVQGIE (PMEL_HUMAN)
  Core: FSVTLDIVQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QVPLDCVLYRYGSXSVXLXIVXGIE

SEQ ID NO: 335258 - protein, 14 aa, Artificial Sequence
  Description of Artificial Sequence: Synthetic peptide
  Seed: QVPLIVGILLVLMA (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXA

SEQ ID NO: 335259 - protein, 15 aa, Artificial Sequence
  Description of Artificial Sequence: Synthetic peptide
  Seed: QVPLIVGILLVLMAV (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAV

SEQ ID NO: 335260 - protein, 16 aa, Artificial Sequence
  Description of Artificial Sequence: Synthetic peptide
  Seed: QVPLIVGILLVLMAVV (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAVV

SEQ ID NO: 335261 - protein, 17 aa, Artificial Sequence
  Description of Artificial Sequence: Synthetic peptide
  Seed: QVPLIVGILLVLMAVVL (PMEL_HUMAN)
  Core: LIVGILLVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVPXIVXIXLVXMAVVL

SEQ ID NO: 335262 - protein, 17 aa, Artificial Sequence
  Description of Artificial Sequence: Synthetic peptide
  Seed: QVPLIVGILLVLMAVVL (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAVVL

SEQ ID NO: 335263 - protein, 18 aa, Artificial Sequence
  Description of Artificial Sequence: Synthetic peptide
  Seed: QVPLIVGILLVLMAVVLA (PMEL_HUMAN)
  Core: ILLVLMAVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGXLLXLXAVXLA

SEQ ID NO: 335264 - protein, 18 aa, Artificial Sequence
  Description of Artificial Sequence: Synthetic peptide
  Seed: QVPLIVGILLVLMAVVLA (PMEL_HUMAN)
  Core: LLVLMAVVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGIXLVXMXVVXA

SEQ ID NO: 335265 - protein, 19 aa, Artificial Sequence
  Description of Artificial Sequence: Synthetic peptide
  Seed: QVPLIVGILLVLMAVVLAS (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAVVLAS

SEQ ID NO: 335266 - protein, 19 aa, Artificial Sequence
  Description of Artificial Sequence: Synthetic peptide
  Seed: QVPLIVGILLVLMAVVLAS (PMEL_HUMAN)
  Core: ILLVLMAVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGXLLXLXAVXLAS

SEQ ID NO: 335267 - protein, 19 aa, Artificial Sequence
  Description of Artificial Sequence: Synthetic peptide
  Seed: QVPLIVGILLVLMAVVLAS (PMEL_HUMAN)
  Core: LLVLMAVVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGIXLVXMXVVXAS

SEQ ID NO: 335268 - protein, 19 aa, Artificial Sequence
  Description of Artificial Sequence: Synthetic peptide
  Seed: QVPLIVGILLVLMAVVLAS (PMEL_HUMAN)
  Core: LVLMAVVLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILXVLXAXVLXS

SEQ ID NO: 335269 - protein, 20 aa, Artificial Sequence
  Description of Artificial Sequence: Synthetic peptide
  Seed: QVPLIVGILLVLMAVVLASL (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAVVLASL

SEQ ID NO: 335270 - protein, 20 aa, Artificial Sequence
  Description of Artificial Sequence: Synthetic peptide
  Seed: QVPLIVGILLVLMAVVLASL (PMEL_HUMAN)
  Core: ILLVLMAVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGXLLXLXAVXLASL

SEQ ID NO: 335271 - protein, 20 aa, Artificial Sequence
  Description of Artificial Sequence: Synthetic peptide
  Seed: QVPLIVGILLVLMAVVLASL (PMEL_HUMAN)
  Core: LLVLMAVVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGIXLVXMXVVXASL

SEQ ID NO: 335272 - protein, 20 aa, Artificial Sequence
  Description of Artificial Sequence: Synthetic peptide
  Seed: QVPLIVGILLVLMAVVLASL (PMEL_HUMAN)
  Core: LVLMAVVLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILXVLXAXVLXSL

SEQ ID NO: 335273 - protein, 21 aa, Artificial Sequence
  Description of Artificial Sequence: Synthetic peptide
  Seed: QVPLIVGILLVLMAVVLASLI (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAVVLASLI

SEQ ID NO: 335274 - protein, 21 aa, Artificial Sequence
  Description of Artificial Sequence: Synthetic peptide
  Seed: QVPLIVGILLVLMAVVLASLI (PMEL_HUMAN)
  Core: ILLVLMAVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGXLLXLXAVXLASLI

SEQ ID NO: 335275 - protein, 21 aa, Artificial Sequence
  Description of Artificial Sequence: Synthetic peptide
  Seed: QVPLIVGILLVLMAVVLASLI (PMEL_HUMAN)
  Core: LLVLMAVVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGIXLVXMXVVXASLI

SEQ ID NO: 335276 - protein, 21 aa, Artificial Sequence
  Description of Artificial Sequence: Synthetic peptide
  Seed: QVPLIVGILLVLMAVVLASLI (PMEL_HUMAN)
  Core: LVLMAVVLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILXVLXAXVLXSLI

SEQ ID NO: 335277 - protein, 22 aa, Artificial Sequence
  Description of Artificial Sequence: Synthetic peptide
  Seed: QVPLIVGILLVLMAVVLASLIY (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAVVLASLIY

SEQ ID NO: 335278 - protein, 22 aa, Artificial Sequence
  Description of Artificial Sequence: Synthetic peptide
  Seed: QVPLIVGILLVLMAVVLASLIY (PMEL_HUMAN)
  Core: ILLVLMAVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGXLLXLXAVXLASLIY

SEQ ID NO: 335279 - protein, 22 aa, Artificial Sequence
  Description of Artificial Sequence: Synthetic peptide
  Seed: QVPLIVGILLVLMAVVLASLIY (PMEL_HUMAN)
  Core: LLVLMAVVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGIXLVXMXVVXASLIY

SEQ ID NO: 335280 - protein, 22 aa, Artificial Sequence
  Description of Artificial Sequence: Synthetic peptide
  Seed: QVPLIVGILLVLMAVVLASLIY (PMEL_HUMAN)
  Core: LVLMAVVLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILXVLXAXVLXSLIY

SEQ ID NO: 335281 - protein, 23 aa, Artificial Sequence
  Description of Artificial Sequence: Synthetic peptide
  Seed: QVPLIVGILLVLMAVVLASLIYR (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAVVLASLIYR

SEQ ID NO: 335282 - protein, 23 aa, Artificial Sequence
  Description of Artificial Sequence: Synthetic peptide
  Seed: QVPLIVGILLVLMAVVLASLIYR (PMEL_HUMAN)
  Core: ILLVLMAVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGXLLXLXAVXLASLIYR

SEQ ID NO: 335283 - protein, 23 aa, Artificial Sequence
  Description of Artificial Sequence: Synthetic peptide
  Seed: QVPLIVGILLVLMAVVLASLIYR (PMEL_HUMAN)
  Core: LLVLMAVVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGIXLVXMXVVXASLIYR

SEQ ID NO: 335284 - protein, 23 aa, Artificial Sequence
  Description of Artificial Sequence: Synthetic peptide
  Seed: QVPLIVGILLVLMAVVLASLIYR (PMEL_HUMAN)
  Core: VLMAVVLAS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLXLMXVXLAXLIYR

SEQ ID NO: 335285 - protein, 23 aa, Artificial Sequence
  Description of Artificial Sequence: Synthetic peptide
  Seed: QVPLIVGILLVLMAVVLASLIYR (PMEL_HUMAN)
  Core: LMAVVLASL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLVXMAXVXASXIYR

SEQ ID NO: 335286 - protein, 23 aa, Artificial Sequence
  Description of Artificial Sequence: Synthetic peptide
  Seed: QVPLIVGILLVLMAVVLASLIYR (PMEL_HUMAN)
  Core: MAVVLASLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLVLXAVXLXSLXYR

SEQ ID NO: 335287 - protein, 24 aa, Artificial Sequence
  Description of Artificial Sequence: Synthetic peptide
  Seed: QVPLIVGILLVLMAVVLASLIYRR (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAVVLASLIYRR

SEQ ID NO: 335288 - protein, 24 aa, Artificial Sequence
  Description of Artificial Sequence: Synthetic peptide
  Seed: QVPLIVGILLVLMAVVLASLIYRR (PMEL_HUMAN)
  Core: ILLVLMAVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGXLLXLXAVXLASLIYRR

SEQ ID NO: 335289 - protein, 24 aa, Artificial Sequence
  Description of Artificial Sequence: Synthetic peptide
  Seed: QVPLIVGILLVLMAVVLASLIYRR (PMEL_HUMAN)
  Core: LLVLMAVVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGIXLVXMXVVXASLIYRR

SEQ ID NO: 335290 - protein, 24 aa, Artificial Sequence
  Description of Artificial Sequence: Synthetic peptide
  Seed: QVPLIVGILLVLMAVVLASLIYRR (PMEL_HUMAN)
  Core: LVLMAVVLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILXVLXAXVLXSLIYRR

SEQ ID NO: 335291 - protein, 24 aa, Artificial Sequence
  Description of Artificial Sequence: Synthetic peptide
  Seed: QVPLIVGILLVLMAVVLASLIYRR (PMEL_HUMAN)
  Core: VLMAVVLAS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLXLMXVXLAXLIYRR

SEQ ID NO: 335292 - protein, 24 aa, Artificial Sequence
  Description of Artificial Sequence: Synthetic peptide
  Seed: QVPLIVGILLVLMAVVLASLIYRR (PMEL_HUMAN)
  Core: LMAVVLASL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLVXMAXVXASXIYRR

SEQ ID NO: 335293 - protein, 24 aa, Artificial Sequence
  Description of Artificial Sequence: Synthetic peptide
  Seed: QVPLIVGILLVLMAVVLASLIYRR (PMEL_HUMAN)
  Core: MAVVLASLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLVLXAVXLXSLXYRR

SEQ ID NO: 335294 - protein, 24 aa, Artificial Sequence
  Description of Artificial Sequence: Synthetic peptide
  Seed: QVPLIVGILLVLMAVVLASLIYRR (PMEL_HUMAN)
  Core: VVLASLIYR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLVLMAXVLXSXIYXR

SEQ ID NO: 335295 - protein, 25 aa, Artificial Sequence
  Description of Artificial Sequence: Synthetic peptide
  Seed: QVPLIVGILLVLMAVVLASLIYRRR (PMEL_HUMAN)
  Core: IVGILLVLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPLXVGXLXVLXAVVLASLIYRRR

SEQ ID NO: 335296 - protein, 25 aa, Artificial Sequence
  Description of Artificial Sequence: Synthetic peptide
  Seed: QVPLIVGILLVLMAVVLASLIYRRR (PMEL_HUMAN)
  Core: LLVLMAVVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGIXLVXMXVVXASLIYRRR

SEQ ID NO: 335297 - protein, 25 aa, Artificial Sequence
  Description of Artificial Sequence: Synthetic peptide
  Seed: QVPLIVGILLVLMAVVLASLIYRRR (PMEL_HUMAN)
  Core: LVLMAVVLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILXVLXAXVLXSLIYRRR

SEQ ID NO: 335298 - protein, 25 aa, Artificial Sequence
  Description of Artificial Sequence: Synthetic peptide
  Seed: QVPLIVGILLVLMAVVLASLIYRRR (PMEL_HUMAN)
  Core: VLMAVVLAS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLXLMXVXLAXLIYRRR

SEQ ID NO: 335299 - protein, 25 aa, Artificial Sequence
  Description of Artificial Sequence: Synthetic peptide
  Seed: QVPLIVGILLVLMAVVLASLIYRRR (PMEL_HUMAN)
  Core: MAVVLASLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLVLXAVXLXSLXYRRR

SEQ ID NO: 335300 - protein, 25 aa, Artificial Sequence
  Description of Artificial Sequence: Synthetic peptide
  Seed: QVPLIVGILLVLMAVVLASLIYRRR (PMEL_HUMAN)
  Core: VVLASLIYR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLVLMAXVLXSXIYXRR

SEQ ID NO: 335301 - protein, 25 aa, Artificial Sequence
  Description of Artificial Sequence: Synthetic peptide
  Seed: QVPLIVGILLVLMAVVLASLIYRRR (PMEL_HUMAN)
  Core: VLASLIYRR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLVLMAVXLAXLXYRXR

SEQ ID NO: 335302 - protein, 25 aa, Artificial Sequence
  Description of Artificial Sequence: Synthetic peptide
  Seed: QVPLIVGILLVLMAVVLASLIYRRR (PMEL_HUMAN)
  Core: LASLIYRRR
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
QVPLIVGILLVLMAVVXASXIXRRX

SEQ ID NO: 335303 - protein, 15 aa, Artificial Sequence
  Description of Artificial Sequence: Synthetic peptide
  Seed: QVPTTEVISTAPVQM (PMEL_HUMAN)
  Core: PTTEVISTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXTTXVXSTXPVQM

SEQ ID NO: 335304 - protein, 15 aa, Artificial Sequence
  Description of Artificial Sequence: Synthetic peptide
  Seed: QVPTTEVISTAPVQM (PMEL_HUMAN)
  Core: TEVISTAPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPTXEVXSXAPXQM

SEQ ID NO: 335305 - protein, 15 aa, Artificial Sequence
  Description of Artificial Sequence: Synthetic peptide
  Seed: QVPTTEVISTAPVQM (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQX

SEQ ID NO: 335306 - protein, 16 aa, Artificial Sequence
  Description of Artificial Sequence: Synthetic peptide
  Seed: QVPTTEVISTAPVQMP (PMEL_HUMAN)
  Core: TEVISTAPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPTXEVXSXAPXQMP

SEQ ID NO: 335307 - protein, 16 aa, Artificial Sequence
  Description of Artificial Sequence: Synthetic peptide
  Seed: QVPTTEVISTAPVQMP (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXP

SEQ ID NO: 335308 - protein, 17 aa, Artificial Sequence
  Description of Artificial Sequence: Synthetic peptide
  Seed: QVPTTEVISTAPVQMPT (PMEL_HUMAN)
  Core: TEVISTAPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QVPTXEVXSXAPXQMPT

SEQ ID NO: 335309 - protein, 17 aa, Artificial Sequence
  Description of Artificial Sequence: Synthetic peptide
  Seed: QVPTTEVISTAPVQMPT (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXPT

SEQ ID NO: 335310 - protein, 18 aa, Artificial Sequence
  Description of Artificial Sequence: Synthetic peptide
  Seed: QVPTTEVISTAPVQMPTA (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXPTA

SEQ ID NO: 335311 - protein, 18 aa, Artificial Sequence
  Description of Artificial Sequence: Synthetic peptide
  Seed: QVPTTEVISTAPVQMPTA (PMEL_HUMAN)
  Core: ISTAPVQMP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVXSTXPXQMXTA

SEQ ID NO: 335312 - protein, 19 aa, Artificial Sequence
  Description of Artificial Sequence: Synthetic peptide
  Seed: QVPTTEVISTAPVQMPTAE (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXPTAE

SEQ ID NO: 335313 - protein, 19 aa, Artificial Sequence
  Description of Artificial Sequence: Synthetic peptide
  Seed: QVPTTEVISTAPVQMPTAE (PMEL_HUMAN)
  Core: ISTAPVQMP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVXSTXPXQMXTAE

SEQ ID NO: 335314 - protein, 20 aa, Artificial Sequence
  Description of Artificial Sequence: Synthetic peptide
  Seed: QVPTTEVISTAPVQMPTAES (PMEL_HUMAN)
  Core: EVISTAPVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTXVIXTXPVXMPTAES

SEQ ID NO: 335315 - protein, 20 aa, Artificial Sequence
  Description of Artificial Sequence: Synthetic peptide
  Seed: QVPTTEVISTAPVQMPTAES (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXPTAES

SEQ ID NO: 335316 - protein, 20 aa, Artificial Sequence
  Description of Artificial Sequence: Synthetic peptide
  Seed: QVPTTEVISTAPVQMPTAES (PMEL_HUMAN)
  Core: ISTAPVQMP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVXSTXPXQMXTAES

SEQ ID NO: 335317 - protein, 20 aa, Artificial Sequence
  Description of Artificial Sequence: Synthetic peptide
  Seed: QVPTTEVISTAPVQMPTAES (PMEL_HUMAN)
  Core: TAPVQMPTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVISXAPXQXPTXES

SEQ ID NO: 335318 - protein, 21 aa, Artificial Sequence
  Description of Artificial Sequence: Synthetic peptide
  Seed: QVPTTEVISTAPVQMPTAEST (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXPTAEST

SEQ ID NO: 335319 - protein, 21 aa, Artificial Sequence
  Description of Artificial Sequence: Synthetic peptide
  Seed: QVPTTEVISTAPVQMPTAEST (PMEL_HUMAN)
  Core: ISTAPVQMP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVXSTXPXQMXTAEST

SEQ ID NO: 335320 - protein, 22 aa, Artificial Sequence
  Description of Artificial Sequence: Synthetic peptide
  Seed: QVPTTEVISTAPVQMPTAESTG (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXPTAESTG

SEQ ID NO: 335321 - protein, 22 aa, Artificial Sequence
  Description of Artificial Sequence: Synthetic peptide
  Seed: QVPTTEVISTAPVQMPTAESTG (PMEL_HUMAN)
  Core: ISTAPVQMP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVXSTXPXQMXTAESTG

SEQ ID NO: 335322 - protein, 23 aa, Artificial Sequence
  Description of Artificial Sequence: Synthetic peptide
  Seed: QVPTTEVISTAPVQMPTAESTGM (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXPTAESTGM

SEQ ID NO: 335323 - protein, 23 aa, Artificial Sequence
  Description of Artificial Sequence: Synthetic peptide
  Seed: QVPTTEVISTAPVQMPTAESTGM (PMEL_HUMAN)
  Core: ISTAPVQMP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVXSTXPXQMXTAESTGM

SEQ ID NO: 335324 - protein, 24 aa, Artificial Sequence
  Description of Artificial Sequence: Synthetic peptide
  Seed: QVPTTEVISTAPVQMPTAESTGMT (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXPTAESTGMT

SEQ ID NO: 335325 - protein, 24 aa, Artificial Sequence
  Description of Artificial Sequence: Synthetic peptide
  Seed: QVPTTEVISTAPVQMPTAESTGMT (PMEL_HUMAN)
  Core: ISTAPVQMP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVXSTXPXQMXTAESTGMT

SEQ ID NO: 335326 - protein, 25 aa, Artificial Sequence
  Description of Artificial Sequence: Synthetic peptide
  Seed: QVPTTEVISTAPVQMPTAESTGMTP (PMEL_HUMAN)
  Core: VISTAPVQM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXISXAXVQXPTAESTGMTP

SEQ ID NO: 335327 - protein, 25 aa, Artificial Sequence
  Description of Artificial Sequence: Synthetic peptide
  Seed: QVPTTEVISTAPVQMPTAESTGMTP (PMEL_HUMAN)
  Core: ISTAPVQMP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVXSTXPXQMXTAESTGMTP

SEQ ID NO: 335328 - protein, 15 aa, Artificial Sequence
  Description of Artificial Sequence: Synthetic peptide
  Seed: QVPTTEVVGTTPGQA (PMEL_HUMAN)
  Core: PTTEVVGTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QVXTTXVXGTXPGQA

SEQ ID NO: 335329 - protein, 15 aa, Artificial Sequence
  Description of Artificial Sequence: Synthetic peptide
  Seed: QVPTTEVVGTTPGQA (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQX

SEQ ID NO: 335330 - protein, 16 aa, Artificial Sequence
  Description of Artificial Sequence: Synthetic peptide
  Seed: QVPTTEVVGTTPGQAP (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXP

SEQ ID NO: 335331 - protein, 17 aa, Artificial Sequence
  Description of Artificial Sequence: Synthetic peptide
  Seed: QVPTTEVVGTTPGQAPT (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXPT

SEQ ID NO: 335332 - protein, 18 aa, Artificial Sequence
  Description of Artificial Sequence: Synthetic peptide
  Seed: QVPTTEVVGTTPGQAPTA (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXPTA

SEQ ID NO: 335333 - protein, 19 aa, Artificial Sequence
  Description of Artificial Sequence: Synthetic peptide
  Seed: QVPTTEVVGTTPGQAPTAE (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXPTAE

SEQ ID NO: 335334 - protein, 20 aa, Artificial Sequence
  Description of Artificial Sequence: Synthetic peptide
  Seed: QVPTTEVVGTTPGQAPTAEP (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXPTAEP

SEQ ID NO: 335335 - protein, 21 aa, Artificial Sequence
  Description of Artificial Sequence: Synthetic peptide
  Seed: QVPTTEVVGTTPGQAPTAEPS (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXPTAEPS

SEQ ID NO: 335336 - protein, 22 aa, Artificial Sequence
  Description of Artificial Sequence: Synthetic peptide
  Seed: QVPTTEVVGTTPGQAPTAEPSG (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXPTAEPSG

SEQ ID NO: 335337 - protein, 22 aa, Artificial Sequence
  Description of Artificial Sequence: Synthetic peptide
  Seed: QVPTTEVVGTTPGQAPTAEPSG (PMEL_HUMAN)
  Core: TTPGQAPTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVVGXTPXQXPTXEPSG

SEQ ID NO: 335338 - protein, 23 aa, Artificial Sequence
  Description of Artificial Sequence: Synthetic peptide
  Seed: QVPTTEVVGTTPGQAPTAEPSGT (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXPTAEPSGT

SEQ ID NO: 335339 - protein, 23 aa, Artificial Sequence
  Description of Artificial Sequence: Synthetic peptide
  Seed: QVPTTEVVGTTPGQAPTAEPSGT (PMEL_HUMAN)
  Core: TTPGQAPTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVVGXTPXQXPTXEPSGT

SEQ ID NO: 335340 - protein, 24 aa, Artificial Sequence
  Description of Artificial Sequence: Synthetic peptide
  Seed: QVPTTEVVGTTPGQAPTAEPSGTT (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXPTAEPSGTT

SEQ ID NO: 335341 - protein, 24 aa, Artificial Sequence
  Description of Artificial Sequence: Synthetic peptide
  Seed: QVPTTEVVGTTPGQAPTAEPSGTT (PMEL_HUMAN)
  Core: TTPGQAPTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVVGXTPXQXPTXEPSGTT

SEQ ID NO: 335342 - protein, 25 aa, Artificial Sequence
  Description of Artificial Sequence: Synthetic peptide
  Seed: QVPTTEVVGTTPGQAPTAEPSGTTS (PMEL_HUMAN)
  Core: VVGTTPGQA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEXVGXTXGQXPTAEPSGTTS

SEQ ID NO: 335343 - protein, 25 aa, Artificial Sequence
  Description of Artificial Sequence: Synthetic peptide
  Seed: QVPTTEVVGTTPGQAPTAEPSGTTS (PMEL_HUMAN)
  Core: TTPGQAPTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVPTTEVVGXTPXQXPTXEPSGTTS

SEQ ID NO: 335344 - protein, 15 aa, Artificial Sequence
  Description of Artificial Sequence: Synthetic peptide
  Seed: QVSLKVSNDGPTLIG (PMEL_HUMAN)
  Core: LKVSNDGPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVSXKVXNXGPXLIG

SEQ ID NO: 335345 - protein, 16 aa, Artificial Sequence
  Description of Artificial Sequence: Synthetic peptide
  Seed: QVSLKVSNDGPTLIGA (PMEL_HUMAN)
  Core: VSNDGPTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKXSNXGXTLXGA

SEQ ID NO: 335346 - protein, 17 aa, Artificial Sequence
  Description of Artificial Sequence: Synthetic peptide
  Seed: QVSLKVSNDGPTLIGAN (PMEL_HUMAN)
  Core: VSNDGPTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKXSNXGXTLXGAN

SEQ ID NO: 335347 - protein, 19 aa, Artificial Sequence
  Description of Artificial Sequence: Synthetic peptide
  Seed: QVSLKVSNDGPTLIGANAS (PMEL_HUMAN)
  Core: VSNDGPTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKXSNXGXTLXGANAS

SEQ ID NO: 335348 - protein, 20 aa, Artificial Sequence
  Description of Artificial Sequence: Synthetic peptide
  Seed: QVSLKVSNDGPTLIGANASF (PMEL_HUMAN)
  Core: LKVSNDGPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVSXKVXNXGPXLIGANASF

SEQ ID NO: 335349 - protein, 20 aa, Artificial Sequence
  Description of Artificial Sequence: Synthetic peptide
  Seed: QVSLKVSNDGPTLIGANASF (PMEL_HUMAN)
  Core: VSNDGPTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKXSNXGXTLXGANASF

SEQ ID NO: 335350 - protein, 20 aa, Artificial Sequence
  Description of Artificial Sequence: Synthetic peptide
  Seed: QVSLKVSNDGPTLIGANASF (PMEL_HUMAN)
  Core: NDGPTLIGA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSXDGXTXIGXNASF

SEQ ID NO: 335351 - protein, 20 aa, Artificial Sequence
  Description of Artificial Sequence: Synthetic peptide
  Seed: QVSLKVSNDGPTLIGANASF (PMEL_HUMAN)
  Core: PTLIGANAS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGXTLXGXNAXF

SEQ ID NO: 335352 - protein, 21 aa, Artificial Sequence
  Description of Artificial Sequence: Synthetic peptide
  Seed: QVSLKVSNDGPTLIGANASFS (PMEL_HUMAN)
  Core: LKVSNDGPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVSXKVXNXGPXLIGANASFS

SEQ ID NO: 335353 - protein, 21 aa, Artificial Sequence
  Description of Artificial Sequence: Synthetic peptide
  Seed: QVSLKVSNDGPTLIGANASFS (PMEL_HUMAN)
  Core: VSNDGPTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKXSNXGXTLXGANASFS

SEQ ID NO: 335354 - protein, 21 aa, Artificial Sequence
  Description of Artificial Sequence: Synthetic peptide
  Seed: QVSLKVSNDGPTLIGANASFS (PMEL_HUMAN)
  Core: PTLIGANAS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGXTLXGXNAXFS

SEQ ID NO: 335355 - protein, 21 aa, Artificial Sequence
  Description of Artificial Sequence: Synthetic peptide
  Seed: QVSLKVSNDGPTLIGANASFS (PMEL_HUMAN)
  Core: LIGANASFS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGPTXIGXNXSFX

SEQ ID NO: 335356 - protein, 22 aa, Artificial Sequence
  Description of Artificial Sequence: Synthetic peptide
  Seed: QVSLKVSNDGPTLIGANASFSI (PMEL_HUMAN)
  Core: LKVSNDGPT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVSXKVXNXGPXLIGANASFSI

SEQ ID NO: 335357 - protein, 22 aa, Artificial Sequence
  Description of Artificial Sequence: Synthetic peptide
  Seed: QVSLKVSNDGPTLIGANASFSI (PMEL_HUMAN)
  Core: VSNDGPTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKXSNXGXTLXGANASFSI

SEQ ID NO: 335358 - protein, 22 aa, Artificial Sequence
  Description of Artificial Sequence: Synthetic peptide
  Seed: QVSLKVSNDGPTLIGANASFSI (PMEL_HUMAN)
  Core: PTLIGANAS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGXTLXGXNAXFSI

SEQ ID NO: 335359 - protein, 22 aa, Artificial Sequence
  Description of Artificial Sequence: Synthetic peptide
  Seed: QVSLKVSNDGPTLIGANASFSI (PMEL_HUMAN)
  Core: LIGANASFS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGPTXIGXNXSFXI

SEQ ID NO: 335360 - protein, 23 aa, Artificial Sequence
  Description of Artificial Sequence: Synthetic peptide
  Seed: QVSLKVSNDGPTLIGANASFSIA (PMEL_HUMAN)
  Core: PTLIGANAS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGXTLXGXNAXFSIA

SEQ ID NO: 335361 - protein, 23 aa, Artificial Sequence
  Description of Artificial Sequence: Synthetic peptide
  Seed: QVSLKVSNDGPTLIGANASFSIA (PMEL_HUMAN)
  Core: LIGANASFS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGPTXIGXNXSFXIA

SEQ ID NO: 335362 - protein, 23 aa, Artificial Sequence
  Description of Artificial Sequence: Synthetic peptide
  Seed: QVSLKVSNDGPTLIGANASFSIA (PMEL_HUMAN)
  Core: IGANASFSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGPTLXGAXAXFSXA

SEQ ID NO: 335363 - protein, 24 aa, Artificial Sequence
  Description of Artificial Sequence: Synthetic peptide
  Seed: QVSLKVSNDGPTLIGANASFSIAL (PMEL_HUMAN)
  Core: PTLIGANAS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGXTLXGXNAXFSIAL

SEQ ID NO: 335364 - protein, 24 aa, Artificial Sequence
  Description of Artificial Sequence: Synthetic peptide
  Seed: QVSLKVSNDGPTLIGANASFSIAL (PMEL_HUMAN)
  Core: LIGANASFS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGPTXIGXNXSFXIAL

SEQ ID NO: 335365 - protein, 24 aa, Artificial Sequence
  Description of Artificial Sequence: Synthetic peptide
  Seed: QVSLKVSNDGPTLIGANASFSIAL (PMEL_HUMAN)
  Core: IGANASFSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGPTLXGAXAXFSXAL

SEQ ID NO: 335366 - protein, 25 aa, Artificial Sequence
  Description of Artificial Sequence: Synthetic peptide
  Seed: QVSLKVSNDGPTLIGANASFSIALN (PMEL_HUMAN)
  Core: PTLIGANAS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGXTLXGXNAXFSIALN

SEQ ID NO: 335367 - protein, 25 aa, Artificial Sequence
  Description of Artificial Sequence: Synthetic peptide
  Seed: QVSLKVSNDGPTLIGANASFSIALN (PMEL_HUMAN)
  Core: LIGANASFS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGPTXIGXNXSFXIALN

SEQ ID NO: 335368 - protein, 25 aa, Artificial Sequence
  Description of Artificial Sequence: Synthetic peptide
  Seed: QVSLKVSNDGPTLIGANASFSIALN (PMEL_HUMAN)
  Core: IGANASFSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
QVSLKVSNDGPTLXGAXAXFSXALN

SEQ ID NO: 335369 - protein, 15 aa, Artificial Sequence
  Description of Artificial Sequence: Synthetic peptide
  Seed: QVTTTEWVETTAREL (PMEL_HUMAN)
  Core: VTTTEWVET
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXTTXEXVEXTAREL

SEQ ID NO: 335370 - protein, 15 aa, Artificial Sequence
  Description of Artificial Sequence: Synthetic peptide
  Seed: QVTTTEWVETTAREL (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREX

SEQ ID NO: 335371 - protein, 16 aa, Artificial Sequence
  Description of Artificial Sequence: Synthetic peptide
  Seed: QVTTTEWVETTARELP (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXP

SEQ ID NO: 335372 - protein, 17 aa, Artificial Sequence
  Description of Artificial Sequence: Synthetic peptide
  Seed: QVTTTEWVETTARELPI (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXPI

SEQ ID NO: 335373 - protein, 18 aa, Artificial Sequence
  Description of Artificial Sequence: Synthetic peptide
  Seed: QVTTTEWVETTARELPIP (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXPIP

SEQ ID NO: 335374 - protein, 19 aa, Artificial Sequence
  Description of Artificial Sequence: Synthetic peptide
  Seed: QVTTTEWVETTARELPIPE (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXPIPE

SEQ ID NO: 335375 - protein, 20 aa, Artificial Sequence
  Description of Artificial Sequence: Synthetic peptide
  Seed: QVTTTEWVETTARELPIPEP (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXPIPEP

SEQ ID NO: 335376 - protein, 21 aa, Artificial Sequence
  Description of Artificial Sequence: Synthetic peptide
  Seed: QVTTTEWVETTARELPIPEPE (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXPIPEPE

SEQ ID NO: 335377 - protein, 22 aa, Artificial Sequence
  Description of Artificial Sequence: Synthetic peptide
  Seed: QVTTTEWVETTARELPIPEPEG (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXPIPEPEG

SEQ ID NO: 335378 - protein, 23 aa, Artificial Sequence
  Description of Artificial Sequence: Synthetic peptide
  Seed: QVTTTEWVETTARELPIPEPEGP (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXPIPEPEGP

SEQ ID NO: 335379 - protein, 24 aa, Artificial Sequence
  Description of Artificial Sequence: Synthetic peptide
  Seed: QVTTTEWVETTARELPIPEPEGPD (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXPIPEPEGPD

SEQ ID NO: 335380 - protein, 25 aa, Artificial Sequence
  Description of Artificial Sequence: Synthetic peptide
  Seed: QVTTTEWVETTARELPIPEPEGPDA (PMEL_HUMAN)
  Core: WVETTAREL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
QVTTTEXVEXTXREXPIPEPEGPDA

SEQ ID NO: 335381 - protein, 13 aa, Artificial Sequence
  Description of Artificial Sequence: Synthetic peptide
  Seed: QVVLQAAIPLTSC (PMEL_HUMAN)
  Core: VVLQAAIPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXAXIPXTSC

SEQ ID NO: 335382 - protein, 13 aa, Artificial Sequence
  Description of Artificial Sequence: Synthetic peptide
  Seed: QVVLQAAIPLTSC (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXC

SEQ ID NO: 335383 - protein, 14 aa, Artificial Sequence
  Description of Artificial Sequence: Synthetic peptide
  Seed: QVVLQAAIPLTSCG (PMEL_HUMAN)
  Core: VVLQAAIPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXAXIPXTSCG

SEQ ID NO: 335384 - protein, 14 aa, Artificial Sequence
  Description of Artificial Sequence: Synthetic peptide
  Seed: QVVLQAAIPLTSCG (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCG

SEQ ID NO: 335385 - protein, 15 aa, Artificial Sequence
  Description of Artificial Sequence: Synthetic peptide
  Seed: QVVLQAAIPLTSCGS (PMEL_HUMAN)
  Core: VVLQAAIPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXAXIPXTSCGS

SEQ ID NO: 335386 - protein, 15 aa, Artificial Sequence
  Description of Artificial Sequence: Synthetic peptide
  Seed: QVVLQAAIPLTSCGS (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGS

SEQ ID NO: 335387 - protein, 16 aa, Artificial Sequence
  Description of Artificial Sequence: Synthetic peptide
  Seed: QVVLQAAIPLTSCGSS (PMEL_HUMAN)
  Core: VVLQAAIPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXAXIPXTSCGSS

SEQ ID NO: 335388 - protein, 16 aa, Artificial Sequence
  Description of Artificial Sequence: Synthetic peptide
  Seed: QVVLQAAIPLTSCGSS (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSS

SEQ ID NO: 335389 - protein, 17 aa, Artificial Sequence
  Description of Artificial Sequence: Synthetic peptide
  Seed: QVVLQAAIPLTSCGSSP (PMEL_HUMAN)
  Core: VVLQAAIPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXVLXAXIPXTSCGSSP

SEQ ID NO: 335390 - protein, 17 aa, Artificial Sequence
  Description of Artificial Sequence: Synthetic peptide
  Seed: QVVLQAAIPLTSCGSSP (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSSP

SEQ ID NO: 335391 - protein, 18 aa, Artificial Sequence
  Description of Artificial Sequence: Synthetic peptide
  Seed: QVVLQAAIPLTSCGSSPV (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSSPV

SEQ ID NO: 335392 - protein, 19 aa, Artificial Sequence
  Description of Artificial Sequence: Synthetic peptide
  Seed: QVVLQAAIPLTSCGSSPVP (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSSPVP

SEQ ID NO: 335393 - protein, 19 aa, Artificial Sequence
  Description of Artificial Sequence: Synthetic peptide
  Seed: QVVLQAAIPLTSCGSSPVP (PMEL_HUMAN)
  Core: LTSCGSSPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPXTSXGXSPXP

SEQ ID NO: 335394 - protein, 20 aa, Artificial Sequence
  Description of Artificial Sequence: Synthetic peptide
  Seed: QVVLQAAIPLTSCGSSPVPG (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSSPVPG

SEQ ID NO: 335395 - protein, 20 aa, Artificial Sequence
  Description of Artificial Sequence: Synthetic peptide
  Seed: QVVLQAAIPLTSCGSSPVPG (PMEL_HUMAN)
  Core: LTSCGSSPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPXTSXGXSPXPG

SEQ ID NO: 335396 - protein, 21 aa, Artificial Sequence
  Description of Artificial Sequence: Synthetic peptide
  Seed: QVVLQAAIPLTSCGSSPVPGT (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSSPVPGT

SEQ ID NO: 335397 - protein, 21 aa, Artificial Sequence
  Description of Artificial Sequence: Synthetic peptide
  Seed: QVVLQAAIPLTSCGSSPVPGT (PMEL_HUMAN)
  Core: LTSCGSSPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPXTSXGXSPXPGT

SEQ ID NO: 335398 - protein, 22 aa, Artificial Sequence
  Description of Artificial Sequence: Synthetic peptide
  Seed: QVVLQAAIPLTSCGSSPVPGTT (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSSPVPGTT

SEQ ID NO: 335399 - protein, 22 aa, Artificial Sequence
  Description of Artificial Sequence: Synthetic peptide
  Seed: QVVLQAAIPLTSCGSSPVPGTT (PMEL_HUMAN)
  Core: LTSCGSSPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPXTSXGXSPXPGTT

SEQ ID NO: 335400 - protein, 23 aa, Artificial Sequence
  Description of Artificial Sequence: Synthetic peptide
  Seed: QVVLQAAIPLTSCGSSPVPGTTD (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSSPVPGTTD

SEQ ID NO: 335401 - protein, 23 aa, Artificial Sequence
  Description of Artificial Sequence: Synthetic peptide
  Seed: QVVLQAAIPLTSCGSSPVPGTTD (PMEL_HUMAN)
  Core: LTSCGSSPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPXTSXGXSPXPGTTD

SEQ ID NO: 335402 - protein, 23 aa, Artificial Sequence
  Description of Artificial Sequence: Synthetic peptide
  Seed: QVVLQAAIPLTSCGSSPVPGTTD (PMEL_HUMAN)
  Core: SCGSSPVPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPLTXCGXSXVPXTTD

SEQ ID NO: 335403 - protein, 24 aa, Artificial Sequence
  Description of Artificial Sequence: Synthetic peptide
  Seed: QVVLQAAIPLTSCGSSPVPGTTDG (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSSPVPGTTDG

SEQ ID NO: 335404 - protein, 24 aa, Artificial Sequence
  Description of Artificial Sequence: Synthetic peptide
  Seed: QVVLQAAIPLTSCGSSPVPGTTDG (PMEL_HUMAN)
  Core: LTSCGSSPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPXTSXGXSPXPGTTDG

SEQ ID NO: 335405 - protein, 24 aa, Artificial Sequence
  Description of Artificial Sequence: Synthetic peptide
  Seed: QVVLQAAIPLTSCGSSPVPGTTDG (PMEL_HUMAN)
  Core: SCGSSPVPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPLTXCGXSXVPXTTDG

SEQ ID NO: 335406 - protein, 25 aa, Artificial Sequence
  Description of Artificial Sequence: Synthetic peptide
  Seed: QVVLQAAIPLTSCGSSPVPGTTDGH (PMEL_HUMAN)
  Core: LQAAIPLTS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
QVVXQAXIXLTXCGSSPVPGTTDGH

SEQ ID NO: 335407 - protein, 25 aa, Artificial Sequence
  Description of Artificial Sequence: Synthetic peptide
  Seed: QVVLQAAIPLTSCGSSPVPGTTDGH (PMEL_HUMAN)
  Core: LTSCGSSPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPXTSXGXSPXPGTTDGH

SEQ ID NO: 335408 - protein, 25 aa, Artificial Sequence
  Description of Artificial Sequence: Synthetic peptide
  Seed: QVVLQAAIPLTSCGSSPVPGTTDGH (PMEL_HUMAN)
  Core: SCGSSPVPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
QVVLQAAIPLTXCGXSXVPXTTDGH

SEQ ID NO: 335409 - protein, 13 aa, Artificial Sequence
  Description of Artificial Sequence: Synthetic peptide
  Seed: QVWGGQPVYPQET (PMEL_HUMAN)
  Core: VWGGQPVYP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWGXQXVYXQET

SEQ ID NO: 335410 - protein, 14 aa, Artificial Sequence
  Description of Artificial Sequence: Synthetic peptide
  Seed: QVWGGQPVYPQETD (PMEL_HUMAN)
  Core: VWGGQPVYP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWGXQXVYXQETD

SEQ ID NO: 335411 - protein, 15 aa, Artificial Sequence
  Description of Artificial Sequence: Synthetic peptide
  Seed: QVWGGQPVYPQETDD (PMEL_HUMAN)
  Core: VWGGQPVYP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWGXQXVYXQETDD

SEQ ID NO: 335412 - protein, 16 aa, Artificial Sequence
  Description of Artificial Sequence: Synthetic peptide
  Seed: QVWGGQPVYPQETDDA (PMEL_HUMAN)
  Core: VWGGQPVYP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWGXQXVYXQETDDA

SEQ ID NO: 335413 - protein, 17 aa, Artificial Sequence
  Description of Artificial Sequence: Synthetic peptide
  Seed: QVWGGQPVYPQETDDAC (PMEL_HUMAN)
  Core: VWGGQPVYP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWGXQXVYXQETDDAC

SEQ ID NO: 335414 - protein, 19 aa, Artificial Sequence
  Description of Artificial Sequence: Synthetic peptide
  Seed: QVWGGQPVYPQETDDACIF (PMEL_HUMAN)
  Core: VWGGQPVYP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWGXQXVYXQETDDACIF

SEQ ID NO: 335415 - protein, 20 aa, Artificial Sequence
  Description of Artificial Sequence: Synthetic peptide
  Seed: QVWGGQPVYPQETDDACIFP (PMEL_HUMAN)
  Core: VWGGQPVYP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWGXQXVYXQETDDACIFP

SEQ ID NO: 335416 - protein, 13 aa, Artificial Sequence
  Description of Artificial Sequence: Synthetic peptide
  Seed: QYWQVLGGPVSGL (PMEL_HUMAN)
  Core: YWQVLGGPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWQXLXGPXSGL

SEQ ID NO: 335417 - protein, 13 aa, Artificial Sequence
  Description of Artificial Sequence: Synthetic peptide
  Seed: QYWQVLGGPVSGL (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGL

SEQ ID NO: 335418 - protein, 13 aa, Artificial Sequence
  Description of Artificial Sequence: Synthetic peptide
  Seed: QYWQVLGGPVSGL (PMEL_HUMAN)
  Core: VLGGPVSGL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QYWQXLGXPXSGX

SEQ ID NO: 335419 - protein, 14 aa, Artificial Sequence
  Description of Artificial Sequence: Synthetic peptide
  Seed: QYWQVLGGPVSGLS (PMEL_HUMAN)
  Core: YWQVLGGPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWQXLXGPXSGLS

SEQ ID NO: 335420 - protein, 14 aa, Artificial Sequence
  Description of Artificial Sequence: Synthetic peptide
  Seed: QYWQVLGGPVSGLS (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLS

SEQ ID NO: 335421 - protein, 14 aa, Artificial Sequence
  Description of Artificial Sequence: Synthetic peptide
  Seed: QYWQVLGGPVSGLS (PMEL_HUMAN)
  Core: VLGGPVSGL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QYWQXLGXPXSGXS

SEQ ID NO: 335422 - protein, 15 aa, Artificial Sequence
  Description of Artificial Sequence: Synthetic peptide
  Seed: QYWQVLGGPVSGLSI (PMEL_HUMAN)
  Core: YWQVLGGPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWQXLXGPXSGLSI

SEQ ID NO: 335423 - protein, 15 aa, Artificial Sequence
  Description of Artificial Sequence: Synthetic peptide
  Seed: QYWQVLGGPVSGLSI (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSI

SEQ ID NO: 335424 - protein, 15 aa, Artificial Sequence
  Description of Artificial Sequence: Synthetic peptide
  Seed: QYWQVLGGPVSGLSI (PMEL_HUMAN)
  Core: VLGGPVSGL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QYWQXLGXPXSGXSI

SEQ ID NO: 335425 - protein, 16 aa, Artificial Sequence
  Description of Artificial Sequence: Synthetic peptide
  Seed: QYWQVLGGPVSGLSIG (PMEL_HUMAN)
  Core: YWQVLGGPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWQXLXGPXSGLSIG

SEQ ID NO: 335426 - protein, 16 aa, Artificial Sequence
  Description of Artificial Sequence: Synthetic peptide
  Seed: QYWQVLGGPVSGLSIG (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIG

SEQ ID NO: 335427 - protein, 16 aa, Artificial Sequence
  Description of Artificial Sequence: Synthetic peptide
  Seed: QYWQVLGGPVSGLSIG (PMEL_HUMAN)
  Core: VLGGPVSGL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QYWQXLGXPXSGXSIG

SEQ ID NO: 335428 - protein, 17 aa, Artificial Sequence
  Description of Artificial Sequence: Synthetic peptide
  Seed: QYWQVLGGPVSGLSIGT (PMEL_HUMAN)
  Core: YWQVLGGPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWQXLXGPXSGLSIGT

SEQ ID NO: 335429 - protein, 17 aa, Artificial Sequence
  Description of Artificial Sequence: Synthetic peptide
  Seed: QYWQVLGGPVSGLSIGT (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIGT

SEQ ID NO: 335430 - protein, 17 aa, Artificial Sequence
  Description of Artificial Sequence: Synthetic peptide
  Seed: QYWQVLGGPVSGLSIGT (PMEL_HUMAN)
  Core: VLGGPVSGL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QYWQXLGXPXSGXSIGT

SEQ ID NO: 335431 - protein, 18 aa, Artificial Sequence
  Description of Artificial Sequence: Synthetic peptide
  Seed: QYWQVLGGPVSGLSIGTG (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIGTG

SEQ ID NO: 335432 - protein, 18 aa, Artificial Sequence
  Description of Artificial Sequence: Synthetic peptide
  Seed: QYWQVLGGPVSGLSIGTG (PMEL_HUMAN)
  Core: VLGGPVSGL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
QYWQXLGXPXSGXSIGTG

SEQ ID NO: 335433 - protein, 18 aa, Artificial Sequence
  Description of Artificial Sequence: Synthetic peptide
  Seed: QYWQVLGGPVSGLSIGTG (PMEL_HUMAN)
  Core: PVSGLSIGT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGXVSXLXIGXG

SEQ ID NO: 335434 - protein, 19 aa, Artificial Sequence
  Description of Artificial Sequence: Synthetic peptide
  Seed: QYWQVLGGPVSGLSIGTGR (PMEL_HUMAN)
  Core: YWQVLGGPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWQXLXGPXSGLSIGTGR

SEQ ID NO: 335435 - protein, 19 aa, Artificial Sequence
  Description of Artificial Sequence: Synthetic peptide
  Seed: QYWQVLGGPVSGLSIGTGR (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIGTGR

SEQ ID NO: 335436 - protein, 19 aa, Artificial Sequence
  Description of Artificial Sequence: Synthetic peptide
  Seed: QYWQVLGGPVSGLSIGTGR (PMEL_HUMAN)
  Core: PVSGLSIGT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGXVSXLXIGXGR

SEQ ID NO: 335437 - protein, 19 aa, Artificial Sequence
  Description of Artificial Sequence: Synthetic peptide
  Seed: QYWQVLGGPVSGLSIGTGR (PMEL_HUMAN)
  Core: VSGLSIGTG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPXSGXSXGTXR

SEQ ID NO: 335438 - protein, 20 aa, Artificial Sequence
  Description of Artificial Sequence: Synthetic peptide
  Seed: QYWQVLGGPVSGLSIGTGRA (PMEL_HUMAN)
  Core: YWQVLGGPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWQXLXGPXSGLSIGTGRA

SEQ ID NO: 335439 - protein, 20 aa, Artificial Sequence
  Description of Artificial Sequence: Synthetic peptide
  Seed: QYWQVLGGPVSGLSIGTGRA (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIGTGRA

SEQ ID NO: 335440 - protein, 20 aa, Artificial Sequence
  Description of Artificial Sequence: Synthetic peptide
  Seed: QYWQVLGGPVSGLSIGTGRA (PMEL_HUMAN)
  Core: PVSGLSIGT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGXVSXLXIGXGRA

SEQ ID NO: 335441 - protein, 20 aa, Artificial Sequence
  Description of Artificial Sequence: Synthetic peptide
  Seed: QYWQVLGGPVSGLSIGTGRA (PMEL_HUMAN)
  Core: VSGLSIGTG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPXSGXSXGTXRA

SEQ ID NO: 335442 - protein, 21 aa, Artificial Sequence
  Description of Artificial Sequence: Synthetic peptide
  Seed: QYWQVLGGPVSGLSIGTGRAM (PMEL_HUMAN)
  Core: YWQVLGGPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWQXLXGPXSGLSIGTGRAM

SEQ ID NO: 335443 - protein, 21 aa, Artificial Sequence
  Description of Artificial Sequence: Synthetic peptide
  Seed: QYWQVLGGPVSGLSIGTGRAM (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIGTGRAM

SEQ ID NO: 335444 - protein, 21 aa, Artificial Sequence
  Description of Artificial Sequence: Synthetic peptide
  Seed: QYWQVLGGPVSGLSIGTGRAM (PMEL_HUMAN)
  Core: PVSGLSIGT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGXVSXLXIGXGRAM

SEQ ID NO: 335445 - protein, 21 aa, Artificial Sequence
  Description of Artificial Sequence: Synthetic peptide
  Seed: QYWQVLGGPVSGLSIGTGRAM (PMEL_HUMAN)
  Core: VSGLSIGTG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPXSGXSXGTXRAM

SEQ ID NO: 335446 - protein, 22 aa, Artificial Sequence
  Description of Artificial Sequence: Synthetic peptide
  Seed: QYWQVLGGPVSGLSIGTGRAML (PMEL_HUMAN)
  Core: YWQVLGGPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
QXWQXLXGPXSGLSIGTGRAML

SEQ ID NO: 335447 - protein, 22 aa, Artificial Sequence
  Description of Artificial Sequence: Synthetic peptide
  Seed: QYWQVLGGPVSGLSIGTGRAML (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIGTGRAML

SEQ ID NO: 335448 - protein, 22 aa, Artificial Sequence
  Description of Artificial Sequence: Synthetic peptide
  Seed: QYWQVLGGPVSGLSIGTGRAML (PMEL_HUMAN)
  Core: PVSGLSIGT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGXVSXLXIGXGRAML

SEQ ID NO: 335449 - protein, 22 aa, Artificial Sequence
  Description of Artificial Sequence: Synthetic peptide
  Seed: QYWQVLGGPVSGLSIGTGRAML (PMEL_HUMAN)
  Core: VSGLSIGTG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPXSGXSXGTXRAML

SEQ ID NO: 335450 - protein, 23 aa, Artificial Sequence
  Description of Artificial Sequence: Synthetic peptide
  Seed: QYWQVLGGPVSGLSIGTGRAMLG (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIGTGRAMLG

SEQ ID NO: 335451 - protein, 23 aa, Artificial Sequence
  Description of Artificial Sequence: Synthetic peptide
  Seed: QYWQVLGGPVSGLSIGTGRAMLG (PMEL_HUMAN)
  Core: PVSGLSIGT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGXVSXLXIGXGRAMLG

SEQ ID NO: 335452 - protein, 23 aa, Artificial Sequence
  Description of Artificial Sequence: Synthetic peptide
  Seed: QYWQVLGGPVSGLSIGTGRAMLG (PMEL_HUMAN)
  Core: VSGLSIGTG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPXSGXSXGTXRAMLG

SEQ ID NO: 335453 - protein, 23 aa, Artificial Sequence
  Description of Artificial Sequence: Synthetic peptide
  Seed: QYWQVLGGPVSGLSIGTGRAMLG (PMEL_HUMAN)
  Core: LSIGTGRAM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPVSGXSIXTXRAXLG

SEQ ID NO: 335454 - protein, 24 aa, Artificial Sequence
  Description of Artificial Sequence: Synthetic peptide
  Seed: QYWQVLGGPVSGLSIGTGRAMLGT (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIGTGRAMLGT

SEQ ID NO: 335455 - protein, 24 aa, Artificial Sequence
  Description of Artificial Sequence: Synthetic peptide
  Seed: QYWQVLGGPVSGLSIGTGRAMLGT (PMEL_HUMAN)
  Core: PVSGLSIGT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGXVSXLXIGXGRAMLGT

SEQ ID NO: 335456 - protein, 24 aa, Artificial Sequence
  Description of Artificial Sequence: Synthetic peptide
  Seed: QYWQVLGGPVSGLSIGTGRAMLGT (PMEL_HUMAN)
  Core: VSGLSIGTG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPXSGXSXGTXRAMLGT

SEQ ID NO: 335457 - protein, 24 aa, Artificial Sequence
  Description of Artificial Sequence: Synthetic peptide
  Seed: QYWQVLGGPVSGLSIGTGRAMLGT (PMEL_HUMAN)
  Core: LSIGTGRAM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPVSGXSIXTXRAXLGT

SEQ ID NO: 335458 - protein, 25 aa, Artificial Sequence
  Description of Artificial Sequence: Synthetic peptide
  Seed: QYWQVLGGPVSGLSIGTGRAMLGTH (PMEL_HUMAN)
  Core: WQVLGGPVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
QYXQVXGXPVXGLSIGTGRAMLGTH

SEQ ID NO: 335459 - protein, 25 aa, Artificial Sequence
  Description of Artificial Sequence: Synthetic peptide
  Seed: QYWQVLGGPVSGLSIGTGRAMLGTH (PMEL_HUMAN)
  Core: VSGLSIGTG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPXSGXSXGTXRAMLGTH

SEQ ID NO: 335460 - protein, 25 aa, Artificial Sequence
  Description of Artificial Sequence: Synthetic peptide
  Seed: QYWQVLGGPVSGLSIGTGRAMLGTH (PMEL_HUMAN)
  Core: LSIGTGRAM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPVSGXSIXTXRAXLGTH

SEQ ID NO: 335461 - protein, 25 aa, Artificial Sequence
  Description of Artificial Sequence: Synthetic peptide
  Seed: QYWQVLGGPVSGLSIGTGRAMLGTH (PMEL_HUMAN)
  Core: IGTGRAMLG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
QYWQVLGGPVSGLSXGTXRXMLXTH

SEQ ID NO: 335462 - protein, 18 aa, Artificial Sequence
  Description of Artificial Sequence: Synthetic peptide
  Seed: RALDGGNKHFLRNQPLTF (PMEL_HUMAN)
  Core: KHFLRNQPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNXHFXRXQPXTF

SEQ ID NO: 335463 - protein, 18 aa, Artificial Sequence
  Description of Artificial Sequence: Synthetic peptide
  Seed: RALDGGNKHFLRNQPLTF (PMEL_HUMAN)
  Core: FLRNQPLTF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHXLRXQXLTX

SEQ ID NO: 335464 - protein, 19 aa, Artificial Sequence
  Description of Artificial Sequence: Synthetic peptide
  Seed: RALDGGNKHFLRNQPLTFA (PMEL_HUMAN)
  Core: KHFLRNQPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNXHFXRXQPXTFA

SEQ ID NO: 335465 - protein, 19 aa, Artificial Sequence
  Description of Artificial Sequence: Synthetic peptide
  Seed: RALDGGNKHFLRNQPLTFA (PMEL_HUMAN)
  Core: FLRNQPLTF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHXLRXQXLTXA

SEQ ID NO: 335466 - protein, 20 aa, Artificial Sequence
  Description of Artificial Sequence: Synthetic peptide
  Seed: RALDGGNKHFLRNQPLTFAL (PMEL_HUMAN)
  Core: KHFLRNQPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNXHFXRXQPXTFAL

SEQ ID NO: 335467 - protein, 20 aa, Artificial Sequence
  Description of Artificial Sequence: Synthetic peptide
  Seed: RALDGGNKHFLRNQPLTFAL (PMEL_HUMAN)
  Core: FLRNQPLTF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHXLRXQXLTXAL

SEQ ID NO: 335468 - protein, 21 aa, Artificial Sequence
  Description of Artificial Sequence: Synthetic peptide
  Seed: RALDGGNKHFLRNQPLTFALQ (PMEL_HUMAN)
  Core: KHFLRNQPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNXHFXRXQPXTFALQ

SEQ ID NO: 335469 - protein, 21 aa, Artificial Sequence
  Description of Artificial Sequence: Synthetic peptide
  Seed: RALDGGNKHFLRNQPLTFALQ (PMEL_HUMAN)
  Core: FLRNQPLTF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHXLRXQXLTXALQ

SEQ ID NO: 335470 - protein, 21 aa, Artificial Sequence
  Description of Artificial Sequence: Synthetic peptide
  Seed: RALDGGNKHFLRNQPLTFALQ (PMEL_HUMAN)
  Core: LRNQPLTFA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFXRNXPXTFXLQ

SEQ ID NO: 335471 - protein, 22 aa, Artificial Sequence
  Description of Artificial Sequence: Synthetic peptide
  Seed: RALDGGNKHFLRNQPLTFALQL (PMEL_HUMAN)
  Core: KHFLRNQPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNXHFXRXQPXTFALQL

SEQ ID NO: 335472 - protein, 22 aa, Artificial Sequence
  Description of Artificial Sequence: Synthetic peptide
  Seed: RALDGGNKHFLRNQPLTFALQL (PMEL_HUMAN)
  Core: FLRNQPLTF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHXLRXQXLTXALQL

SEQ ID NO: 335473 - protein, 22 aa, Artificial Sequence
  Description of Artificial Sequence: Synthetic peptide
  Seed: RALDGGNKHFLRNQPLTFALQL (PMEL_HUMAN)
  Core: LRNQPLTFA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFXRNXPXTFXLQL

SEQ ID NO: 335474 - protein, 23 aa, Artificial Sequence
  Description of Artificial Sequence: Synthetic peptide
  Seed: RALDGGNKHFLRNQPLTFALQLH (PMEL_HUMAN)
  Core: KHFLRNQPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNXHFXRXQPXTFALQLH

SEQ ID NO: 335475 - protein, 23 aa, Artificial Sequence
  Description of Artificial Sequence: Synthetic peptide
  Seed: RALDGGNKHFLRNQPLTFALQLH (PMEL_HUMAN)
  Core: FLRNQPLTF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHXLRXQXLTXALQLH

SEQ ID NO: 335476 - protein, 23 aa, Artificial Sequence
  Description of Artificial Sequence: Synthetic peptide
  Seed: RALDGGNKHFLRNQPLTFALQLH (PMEL_HUMAN)
  Core: LRNQPLTFA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFXRNXPXTFXLQLH

SEQ ID NO: 335477 - protein, 23 aa, Artificial Sequence
  Description of Artificial Sequence: Synthetic peptide
  Seed: RALDGGNKHFLRNQPLTFALQLH (PMEL_HUMAN)
  Core: RNQPLTFAL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFLXNQXLXFAXQLH

SEQ ID NO: 335478 - protein, 24 aa, Artificial Sequence
  Description of Artificial Sequence: Synthetic peptide
  Seed: RALDGGNKHFLRNQPLTFALQLHD (PMEL_HUMAN)
  Core: KHFLRNQPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNXHFXRXQPXTFALQLHD

SEQ ID NO: 335479 - protein, 24 aa, Artificial Sequence
  Description of Artificial Sequence: Synthetic peptide
  Seed: RALDGGNKHFLRNQPLTFALQLHD (PMEL_HUMAN)
  Core: FLRNQPLTF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHXLRXQXLTXALQLHD

SEQ ID NO: 335480 - protein, 24 aa, Artificial Sequence
  Description of Artificial Sequence: Synthetic peptide
  Seed: RALDGGNKHFLRNQPLTFALQLHD (PMEL_HUMAN)
  Core: LRNQPLTFA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFXRNXPXTFXLQLHD

SEQ ID NO: 335481 - protein, 24 aa, Artificial Sequence
  Description of Artificial Sequence: Synthetic peptide
  Seed: RALDGGNKHFLRNQPLTFALQLHD (PMEL_HUMAN)
  Core: RNQPLTFAL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFLXNQXLXFAXQLHD

SEQ ID NO: 335482 - protein, 24 aa, Artificial Sequence
  Description of Artificial Sequence: Synthetic peptide
  Seed: RALDGGNKHFLRNQPLTFALQLHD (PMEL_HUMAN)
  Core: PLTFALQLH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFLRNQXLTXAXQLXD

SEQ ID NO: 335483 - protein, 25 aa, Artificial Sequence
  Description of Artificial Sequence: Synthetic peptide
  Seed: RALDGGNKHFLRNQPLTFALQLHDP (PMEL_HUMAN)
  Core: KHFLRNQPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNXHFXRXQPXTFALQLHDP

SEQ ID NO: 335484 - protein, 25 aa, Artificial Sequence
  Description of Artificial Sequence: Synthetic peptide
  Seed: RALDGGNKHFLRNQPLTFALQLHDP (PMEL_HUMAN)
  Core: FLRNQPLTF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHXLRXQXLTXALQLHDP

SEQ ID NO: 335485 - protein, 25 aa, Artificial Sequence
  Description of Artificial Sequence: Synthetic peptide
  Seed: RALDGGNKHFLRNQPLTFALQLHDP (PMEL_HUMAN)
  Core: LRNQPLTFA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFXRNXPXTFXLQLHDP

SEQ ID NO: 335486 - protein, 25 aa, Artificial Sequence
  Description of Artificial Sequence: Synthetic peptide
  Seed: RALDGGNKHFLRNQPLTFALQLHDP (PMEL_HUMAN)
  Core: RNQPLTFAL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFLXNQXLXFAXQLHDP

SEQ ID NO: 335487 - protein, 25 aa, Artificial Sequence
  Description of Artificial Sequence: Synthetic peptide
  Seed: RALDGGNKHFLRNQPLTFALQLHDP (PMEL_HUMAN)
  Core: PLTFALQLH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFLRNQXLTXAXQLXDP

SEQ ID NO: 335488 - protein, 25 aa, Artificial Sequence
  Description of Artificial Sequence: Synthetic peptide
  Seed: RALDGGNKHFLRNQPLTFALQLHDP (PMEL_HUMAN)
  Core: LTFALQLHD
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RALDGGNKHFLRNQPXTFXLXLHXP

SEQ ID NO: 335489 - protein, 13 aa, Artificial Sequence
  Description of Artificial Sequence: Synthetic peptide
  Seed: RALVVTHTYLEPG (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPG

SEQ ID NO: 335490 - protein, 13 aa, Artificial Sequence
  Description of Artificial Sequence: Synthetic peptide
  Seed: RALVVTHTYLEPG (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXG

SEQ ID NO: 335491 - protein, 14 aa, Artificial Sequence
  Description of Artificial Sequence: Synthetic peptide
  Seed: RALVVTHTYLEPGP (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGP

SEQ ID NO: 335492 - protein, 14 aa, Artificial Sequence
  Description of Artificial Sequence: Synthetic peptide
  Seed: RALVVTHTYLEPGP (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGP

SEQ ID NO: 335493 - protein, 15 aa, Artificial Sequence
  Description of Artificial Sequence: Synthetic peptide
  Seed: RALVVTHTYLEPGPV (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPV

SEQ ID NO: 335494 - protein, 15 aa, Artificial Sequence
  Description of Artificial Sequence: Synthetic peptide
  Seed: RALVVTHTYLEPGPV (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPV

SEQ ID NO: 335495 - protein, 15 aa, Artificial Sequence
  Description of Artificial Sequence: Synthetic peptide
  Seed: RALVVTHTYLEPGPV (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPV

SEQ ID NO: 335496 - protein, 16 aa, Artificial Sequence
  Description of Artificial Sequence: Synthetic peptide
  Seed: RALVVTHTYLEPGPVT (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPVT

SEQ ID NO: 335497 - protein, 16 aa, Artificial Sequence
  Description of Artificial Sequence: Synthetic peptide
  Seed: RALVVTHTYLEPGPVT (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVT

SEQ ID NO: 335498 - protein, 16 aa, Artificial Sequence
  Description of Artificial Sequence: Synthetic peptide
  Seed: RALVVTHTYLEPGPVT (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVT

SEQ ID NO: 335499 - protein, 17 aa, Artificial Sequence
  Description of Artificial Sequence: Synthetic peptide
  Seed: RALVVTHTYLEPGPVTA (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPVTA

SEQ ID NO: 335500 - protein, 17 aa, Artificial Sequence
  Description of Artificial Sequence: Synthetic peptide
  Seed: RALVVTHTYLEPGPVTA (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVTA

SEQ ID NO: 335501 - protein, 17 aa, Artificial Sequence
  Description of Artificial Sequence: Synthetic peptide
  Seed: RALVVTHTYLEPGPVTA (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVTA

SEQ ID NO: 335502 - protein, 17 aa, Artificial Sequence
  Description of Artificial Sequence: Synthetic peptide
  Seed: RALVVTHTYLEPGPVTA (PMEL_HUMAN)
  Core: HTYLEPGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTXTYXEXGPXTA

SEQ ID NO: 335503 - protein, 18 aa, Artificial Sequence
  Description of Artificial Sequence: Synthetic peptide
  Seed: RALVVTHTYLEPGPVTAQ (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVTAQ

SEQ ID NO: 335504 - protein, 18 aa, Artificial Sequence
  Description of Artificial Sequence: Synthetic peptide
  Seed: RALVVTHTYLEPGPVTAQ (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVTAQ

SEQ ID NO: 335505 - protein, 19 aa, Artificial Sequence
  Description of Artificial Sequence: Synthetic peptide
  Seed: RALVVTHTYLEPGPVTAQV (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPVTAQV

SEQ ID NO: 335506 - protein, 19 aa, Artificial Sequence
  Description of Artificial Sequence: Synthetic peptide
  Seed: RALVVTHTYLEPGPVTAQV (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVTAQV

SEQ ID NO: 335507 - protein, 19 aa, Artificial Sequence
  Description of Artificial Sequence: Synthetic peptide
  Seed: RALVVTHTYLEPGPVTAQV (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVTAQV

SEQ ID NO: 335508 - protein, 19 aa, Artificial Sequence
  Description of Artificial Sequence: Synthetic peptide
  Seed: RALVVTHTYLEPGPVTAQV (PMEL_HUMAN)
  Core: HTYLEPGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTXTYXEXGPXTAQV

SEQ ID NO: 335509 - protein, 20 aa, Artificial Sequence
  Description of Artificial Sequence: Synthetic peptide
  Seed: RALVVTHTYLEPGPVTAQVV (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPVTAQVV

SEQ ID NO: 335510 - protein, 20 aa, Artificial Sequence
  Description of Artificial Sequence: Synthetic peptide
  Seed: RALVVTHTYLEPGPVTAQVV (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVTAQVV

SEQ ID NO: 335511 - protein, 20 aa, Artificial Sequence
  Description of Artificial Sequence: Synthetic peptide
  Seed: RALVVTHTYLEPGPVTAQVV (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVTAQVV

SEQ ID NO: 335512 - protein, 20 aa, Artificial Sequence
  Description of Artificial Sequence: Synthetic peptide
  Seed: RALVVTHTYLEPGPVTAQVV (PMEL_HUMAN)
  Core: HTYLEPGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTXTYXEXGPXTAQVV

SEQ ID NO: 335513 - protein, 21 aa, Artificial Sequence
  Description of Artificial Sequence: Synthetic peptide
  Seed: RALVVTHTYLEPGPVTAQVVL (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPVTAQVVL

SEQ ID NO: 335514 - protein, 21 aa, Artificial Sequence
  Description of Artificial Sequence: Synthetic peptide
  Seed: RALVVTHTYLEPGPVTAQVVL (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVTAQVVL

SEQ ID NO: 335515 - protein, 21 aa, Artificial Sequence
  Description of Artificial Sequence: Synthetic peptide
  Seed: RALVVTHTYLEPGPVTAQVVL (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVTAQVVL

SEQ ID NO: 335516 - protein, 21 aa, Artificial Sequence
  Description of Artificial Sequence: Synthetic peptide
  Seed: RALVVTHTYLEPGPVTAQVVL (PMEL_HUMAN)
  Core: HTYLEPGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTXTYXEXGPXTAQVVL

SEQ ID NO: 335517 - protein, 22 aa, Artificial Sequence
  Description of Artificial Sequence: Synthetic peptide
  Seed: RALVVTHTYLEPGPVTAQVVLQ (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPVTAQVVLQ

SEQ ID NO: 335518 - protein, 22 aa, Artificial Sequence
  Description of Artificial Sequence: Synthetic peptide
  Seed: RALVVTHTYLEPGPVTAQVVLQ (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVTAQVVLQ

SEQ ID NO: 335519 - protein, 22 aa, Artificial Sequence
  Description of Artificial Sequence: Synthetic peptide
  Seed: RALVVTHTYLEPGPVTAQVVLQ (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVTAQVVLQ

SEQ ID NO: 335520 - protein, 22 aa, Artificial Sequence
  Description of Artificial Sequence: Synthetic peptide
  Seed: RALVVTHTYLEPGPVTAQVVLQ (PMEL_HUMAN)
  Core: HTYLEPGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTXTYXEXGPXTAQVVLQ

SEQ ID NO: 335521 - protein, 22 aa, Artificial Sequence
  Description of Artificial Sequence: Synthetic peptide
  Seed: RALVVTHTYLEPGPVTAQVVLQ (PMEL_HUMAN)
  Core: PGPVTAQVV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTHTYLEXGPXTXQVXLQ

SEQ ID NO: 335522 - protein, 22 aa, Artificial Sequence
  Description of Artificial Sequence: Synthetic peptide
  Seed: RALVVTHTYLEPGPVTAQVVLQ (PMEL_HUMAN)
  Core: PVTAQVVLQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTHTYLEPGXVTXQXVLX

SEQ ID NO: 335523 - protein, 23 aa, Artificial Sequence
  Description of Artificial Sequence: Synthetic peptide
  Seed: RALVVTHTYLEPGPVTAQVVLQA (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPVTAQVVLQA

SEQ ID NO: 335524 - protein, 23 aa, Artificial Sequence
  Description of Artificial Sequence: Synthetic peptide
  Seed: RALVVTHTYLEPGPVTAQVVLQA (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVTAQVVLQA

SEQ ID NO: 335525 - protein, 23 aa, Artificial Sequence
  Description of Artificial Sequence: Synthetic peptide
  Seed: RALVVTHTYLEPGPVTAQVVLQA (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVTAQVVLQA

SEQ ID NO: 335526 - protein, 23 aa, Artificial Sequence
  Description of Artificial Sequence: Synthetic peptide
  Seed: RALVVTHTYLEPGPVTAQVVLQA (PMEL_HUMAN)
  Core: HTYLEPGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTXTYXEXGPXTAQVVLQA

SEQ ID NO: 335527 - protein, 23 aa, Artificial Sequence
  Description of Artificial Sequence: Synthetic peptide
  Seed: RALVVTHTYLEPGPVTAQVVLQA (PMEL_HUMAN)
  Core: PGPVTAQVV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTHTYLEXGPXTXQVXLQA

SEQ ID NO: 335528 - protein, 23 aa, Artificial Sequence
  Description of Artificial Sequence: Synthetic peptide
  Seed: RALVVTHTYLEPGPVTAQVVLQA (PMEL_HUMAN)
  Core: PVTAQVVLQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTHTYLEPGXVTXQXVLXA

SEQ ID NO: 335529 - protein, 24 aa, Artificial Sequence
  Description of Artificial Sequence: Synthetic peptide
  Seed: RALVVTHTYLEPGPVTAQVVLQAA (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPVTAQVVLQAA

SEQ ID NO: 335530 - protein, 24 aa, Artificial Sequence
  Description of Artificial Sequence: Synthetic peptide
  Seed: RALVVTHTYLEPGPVTAQVVLQAA (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVTAQVVLQAA

SEQ ID NO: 335531 - protein, 24 aa, Artificial Sequence
  Description of Artificial Sequence: Synthetic peptide
  Seed: RALVVTHTYLEPGPVTAQVVLQAA (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVTAQVVLQAA

SEQ ID NO: 335532 - protein, 24 aa, Artificial Sequence
  Description of Artificial Sequence: Synthetic peptide
  Seed: RALVVTHTYLEPGPVTAQVVLQAA (PMEL_HUMAN)
  Core: HTYLEPGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTXTYXEXGPXTAQVVLQAA

SEQ ID NO: 335533 - protein, 24 aa, Artificial Sequence
  Description of Artificial Sequence: Synthetic peptide
  Seed: RALVVTHTYLEPGPVTAQVVLQAA (PMEL_HUMAN)
  Core: PVTAQVVLQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTHTYLEPGXVTXQXVLXAA

SEQ ID NO: 335534 - protein, 24 aa, Artificial Sequence
  Description of Artificial Sequence: Synthetic peptide
  Seed: RALVVTHTYLEPGPVTAQVVLQAA (PMEL_HUMAN)
  Core: VTAQVVLQA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTHTYLEPGPXTAXVXLQXA

SEQ ID NO: 335535 - protein, 25 aa, Artificial Sequence
  Description of Artificial Sequence: Synthetic peptide
  Seed: RALVVTHTYLEPGPVTAQVVLQAAI (PMEL_HUMAN)
  Core: LVVTHTYLE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXVVXHXYLXPGPVTAQVVLQAAI

SEQ ID NO: 335536 - protein, 25 aa, Artificial Sequence
  Description of Artificial Sequence: Synthetic peptide
  Seed: RALVVTHTYLEPGPVTAQVVLQAAI (PMEL_HUMAN)
  Core: VVTHTYLEP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RALXVTXTXLEXGPVTAQVVLQAAI

SEQ ID NO: 335537 - protein, 25 aa, Artificial Sequence
  Description of Artificial Sequence: Synthetic peptide
  Seed: RALVVTHTYLEPGPVTAQVVLQAAI (PMEL_HUMAN)
  Core: VTHTYLEPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RALVXTHXYXEPXPVTAQVVLQAAI

SEQ ID NO: 335538 - protein, 25 aa, Artificial Sequence
  Description of Artificial Sequence: Synthetic peptide
  Seed: RALVVTHTYLEPGPVTAQVVLQAAI (PMEL_HUMAN)
  Core: HTYLEPGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTXTYXEXGPXTAQVVLQAAI

SEQ ID NO: 335539 - protein, 25 aa, Artificial Sequence
  Description of Artificial Sequence: Synthetic peptide
  Seed: RALVVTHTYLEPGPVTAQVVLQAAI (PMEL_HUMAN)
  Core: PVTAQVVLQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTHTYLEPGXVTXQXVLXAAI

SEQ ID NO: 335540 - protein, 25 aa, Artificial Sequence
  Description of Artificial Sequence: Synthetic peptide
  Seed: RALVVTHTYLEPGPVTAQVVLQAAI (PMEL_HUMAN)
  Core: VTAQVVLQA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RALVVTHTYLEPGPXTAXVXLQXAI

SEQ ID NO: 335541 - protein, 13 aa, Artificial Sequence
  Description of Artificial Sequence: Synthetic peptide
  Seed: RAMLGTHTMEVTV (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTV

SEQ ID NO: 335542 - protein, 14 aa, Artificial Sequence
  Description of Artificial Sequence: Synthetic peptide
  Seed: RAMLGTHTMEVTVY (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVY

SEQ ID NO: 335543 - protein, 14 aa, Artificial Sequence
  Description of Artificial Sequence: Synthetic peptide
  Seed: RAMLGTHTMEVTVY (PMEL_HUMAN)
  Core: LGTHTMEVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RAMXGTXTXEVXVY

SEQ ID NO: 335544 - protein, 14 aa, Artificial Sequence
  Description of Artificial Sequence: Synthetic peptide
  Seed: RAMLGTHTMEVTVY (PMEL_HUMAN)
  Core: THTMEVTVY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGXHTXEXTVX

SEQ ID NO: 335545 - protein, 15 aa, Artificial Sequence
  Description of Artificial Sequence: Synthetic peptide
  Seed: RAMLGTHTMEVTVYH (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYH

SEQ ID NO: 335546 - protein, 15 aa, Artificial Sequence
  Description of Artificial Sequence: Synthetic peptide
  Seed: RAMLGTHTMEVTVYH (PMEL_HUMAN)
  Core: LGTHTMEVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RAMXGTXTXEVXVYH

SEQ ID NO: 335547 - protein, 15 aa, Artificial Sequence
  Description of Artificial Sequence: Synthetic peptide
  Seed: RAMLGTHTMEVTVYH (PMEL_HUMAN)
  Core: THTMEVTVY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGXHTXEXTVXH

SEQ ID NO: 335548 - protein, 16 aa, Artificial Sequence
  Description of Artificial Sequence: Synthetic peptide
  Seed: RAMLGTHTMEVTVYHR (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHR

SEQ ID NO: 335549 - protein, 16 aa, Artificial Sequence
  Description of Artificial Sequence: Synthetic peptide
  Seed: RAMLGTHTMEVTVYHR (PMEL_HUMAN)
  Core: LGTHTMEVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RAMXGTXTXEVXVYHR

SEQ ID NO: 335550 - protein, 16 aa, Artificial Sequence
  Description of Artificial Sequence: Synthetic peptide
  Seed: RAMLGTHTMEVTVYHR (PMEL_HUMAN)
  Core: THTMEVTVY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGXHTXEXTVXHR

SEQ ID NO: 335551 - protein, 16 aa, Artificial Sequence
  Description of Artificial Sequence: Synthetic peptide
  Seed: RAMLGTHTMEVTVYHR (PMEL_HUMAN)
  Core: HTMEVTVYH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTXTMXVXVYXR

SEQ ID NO: 335552 - protein, 17 aa, Artificial Sequence
  Description of Artificial Sequence: Synthetic peptide
  Seed: RAMLGTHTMEVTVYHRR (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHRR

SEQ ID NO: 335553 - protein, 17 aa, Artificial Sequence
  Description of Artificial Sequence: Synthetic peptide
  Seed: RAMLGTHTMEVTVYHRR (PMEL_HUMAN)
  Core: LGTHTMEVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RAMXGTXTXEVXVYHRR

SEQ ID NO: 335554 - protein, 17 aa, Artificial Sequence
  Description of Artificial Sequence: Synthetic peptide
  Seed: RAMLGTHTMEVTVYHRR (PMEL_HUMAN)
  Core: THTMEVTVY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGXHTXEXTVXHRR

SEQ ID NO: 335555 - protein, 17 aa, Artificial Sequence
  Description of Artificial Sequence: Synthetic peptide
  Seed: RAMLGTHTMEVTVYHRR (PMEL_HUMAN)
  Core: HTMEVTVYH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTXTMXVXVYXRR

SEQ ID NO: 335556 - protein, 17 aa, Artificial Sequence
  Description of Artificial Sequence: Synthetic peptide
  Seed: RAMLGTHTMEVTVYHRR (PMEL_HUMAN)
  Core: MEVTVYHRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTXEVXVXHRX

SEQ ID NO: 335557 - protein, 18 aa, Artificial Sequence
  Description of Artificial Sequence: Synthetic peptide
  Seed: RAMLGTHTMEVTVYHRRG (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHRRG

SEQ ID NO: 335558 - protein, 18 aa, Artificial Sequence
  Description of Artificial Sequence: Synthetic peptide
  Seed: RAMLGTHTMEVTVYHRRG (PMEL_HUMAN)
  Core: LGTHTMEVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RAMXGTXTXEVXVYHRRG

SEQ ID NO: 335559 - protein, 18 aa, Artificial Sequence
  Description of Artificial Sequence: Synthetic peptide
  Seed: RAMLGTHTMEVTVYHRRG (PMEL_HUMAN)
  Core: HTMEVTVYH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTXTMXVXVYXRRG

SEQ ID NO: 335560 - protein, 18 aa, Artificial Sequence
  Description of Artificial Sequence: Synthetic peptide
  Seed: RAMLGTHTMEVTVYHRRG (PMEL_HUMAN)
  Core: MEVTVYHRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTXEVXVXHRXG

SEQ ID NO: 335561 - protein, 19 aa, Artificial Sequence
  Description of Artificial Sequence: Synthetic peptide
  Seed: RAMLGTHTMEVTVYHRRGS (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHRRGS

SEQ ID NO: 335562 - protein, 19 aa, Artificial Sequence
  Description of Artificial Sequence: Synthetic peptide
  Seed: RAMLGTHTMEVTVYHRRGS (PMEL_HUMAN)
  Core: THTMEVTVY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGXHTXEXTVXHRRGS

SEQ ID NO: 335563 - protein, 19 aa, Artificial Sequence
  Description of Artificial Sequence: Synthetic peptide
  Seed: RAMLGTHTMEVTVYHRRGS (PMEL_HUMAN)
  Core: HTMEVTVYH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTXTMXVXVYXRRGS

SEQ ID NO: 335564 - protein, 19 aa, Artificial Sequence
  Description of Artificial Sequence: Synthetic peptide
  Seed: RAMLGTHTMEVTVYHRRGS (PMEL_HUMAN)
  Core: TMEVTVYHR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHXMEXTXYHXRGS

SEQ ID NO: 335565 - protein, 19 aa, Artificial Sequence
  Description of Artificial Sequence: Synthetic peptide
  Seed: RAMLGTHTMEVTVYHRRGS (PMEL_HUMAN)
  Core: MEVTVYHRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTXEVXVXHRXGS

SEQ ID NO: 335566 - protein, 19 aa, Artificial Sequence
  Description of Artificial Sequence: Synthetic peptide
  Seed: RAMLGTHTMEVTVYHRRGS (PMEL_HUMAN)
  Core: VTVYHRRGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMEXTVXHXRGX

SEQ ID NO: 335567 - protein, 20 aa, Artificial Sequence
  Description of Artificial Sequence: Synthetic peptide
  Seed: RAMLGTHTMEVTVYHRRGSR (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHRRGSR

SEQ ID NO: 335568 - protein, 20 aa, Artificial Sequence
  Description of Artificial Sequence: Synthetic peptide
  Seed: RAMLGTHTMEVTVYHRRGSR (PMEL_HUMAN)
  Core: THTMEVTVY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGXHTXEXTVXHRRGSR

SEQ ID NO: 335569 - protein, 20 aa, Artificial Sequence
  Description of Artificial Sequence: Synthetic peptide
  Seed: RAMLGTHTMEVTVYHRRGSR (PMEL_HUMAN)
  Core: HTMEVTVYH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTXTMXVXVYXRRGSR

SEQ ID NO: 335570 - protein, 20 aa, Artificial Sequence
  Description of Artificial Sequence: Synthetic peptide
  Seed: RAMLGTHTMEVTVYHRRGSR (PMEL_HUMAN)
  Core: TMEVTVYHR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHXMEXTXYHXRGSR

SEQ ID NO: 335571 - protein, 20 aa, Artificial Sequence
  Description of Artificial Sequence: Synthetic peptide
  Seed: RAMLGTHTMEVTVYHRRGSR (PMEL_HUMAN)
  Core: MEVTVYHRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTXEVXVXHRXGSR

SEQ ID NO: 335572 - protein, 20 aa, Artificial Sequence
  Description of Artificial Sequence: Synthetic peptide
  Seed: RAMLGTHTMEVTVYHRRGSR (PMEL_HUMAN)
  Core: EVTVYHRRG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMXVTXYXRRXSR

SEQ ID NO: 335573 - protein, 20 aa, Artificial Sequence
  Description of Artificial Sequence: Synthetic peptide
  Seed: RAMLGTHTMEVTVYHRRGSR (PMEL_HUMAN)
  Core: VTVYHRRGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMEXTVXHXRGXR

SEQ ID NO: 335574 - protein, 21 aa, Artificial Sequence
  Description of Artificial Sequence: Synthetic peptide
  Seed: RAMLGTHTMEVTVYHRRGSRS (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHRRGSRS

SEQ ID NO: 335575 - protein, 21 aa, Artificial Sequence
  Description of Artificial Sequence: Synthetic peptide
  Seed: RAMLGTHTMEVTVYHRRGSRS (PMEL_HUMAN)
  Core: HTMEVTVYH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTXTMXVXVYXRRGSRS

SEQ ID NO: 335576 - protein, 21 aa, Artificial Sequence
  Description of Artificial Sequence: Synthetic peptide
  Seed: RAMLGTHTMEVTVYHRRGSRS (PMEL_HUMAN)
  Core: MEVTVYHRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTXEVXVXHRXGSRS

SEQ ID NO: 335577 - protein, 21 aa, Artificial Sequence
  Description of Artificial Sequence: Synthetic peptide
  Seed: RAMLGTHTMEVTVYHRRGSRS (PMEL_HUMAN)
  Core: VTVYHRRGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMEXTVXHXRGXRS

SEQ ID NO: 335578 - protein, 22 aa, Artificial Sequence
  Description of Artificial Sequence: Synthetic peptide
  Seed: RAMLGTHTMEVTVYHRRGSRSY (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHRRGSRSY

SEQ ID NO: 335579 - protein, 22 aa, Artificial Sequence
  Description of Artificial Sequence: Synthetic peptide
  Seed: RAMLGTHTMEVTVYHRRGSRSY (PMEL_HUMAN)
  Core: MEVTVYHRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTXEVXVXHRXGSRSY

SEQ ID NO: 335580 - protein, 22 aa, Artificial Sequence
  Description of Artificial Sequence: Synthetic peptide
  Seed: RAMLGTHTMEVTVYHRRGSRSY (PMEL_HUMAN)
  Core: VTVYHRRGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMEXTVXHXRGXRSY

SEQ ID NO: 335581 - protein, 23 aa, Artificial Sequence
  Description of Artificial Sequence: Synthetic peptide
  Seed: RAMLGTHTMEVTVYHRRGSRSYV (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHRRGSRSYV

SEQ ID NO: 335582 - protein, 23 aa, Artificial Sequence
  Description of Artificial Sequence: Synthetic peptide
  Seed: RAMLGTHTMEVTVYHRRGSRSYV (PMEL_HUMAN)
  Core: MEVTVYHRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTXEVXVXHRXGSRSYV

SEQ ID NO: 335583 - protein, 23 aa, Artificial Sequence
  Description of Artificial Sequence: Synthetic peptide
  Seed: RAMLGTHTMEVTVYHRRGSRSYV (PMEL_HUMAN)
  Core: VTVYHRRGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMEXTVXHXRGXRSYV

SEQ ID NO: 335584 - protein, 24 aa, Artificial Sequence
  Description of Artificial Sequence: Synthetic peptide
  Seed: RAMLGTHTMEVTVYHRRGSRSYVP (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHRRGSRSYVP

SEQ ID NO: 335585 - protein, 24 aa, Artificial Sequence
  Description of Artificial Sequence: Synthetic peptide
  Seed: RAMLGTHTMEVTVYHRRGSRSYVP (PMEL_HUMAN)
  Core: MEVTVYHRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTXEVXVXHRXGSRSYVP

SEQ ID NO: 335586 - protein, 24 aa, Artificial Sequence
  Description of Artificial Sequence: Synthetic peptide
  Seed: RAMLGTHTMEVTVYHRRGSRSYVP (PMEL_HUMAN)
  Core: VTVYHRRGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMEXTVXHXRGXRSYVP

SEQ ID NO: 335587 - protein, 24 aa, Artificial Sequence
  Description of Artificial Sequence: Synthetic peptide
  Seed: RAMLGTHTMEVTVYHRRGSRSYVP (PMEL_HUMAN)
  Core: YHRRGSRSY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMEVTVXHRXGXRSXVP

SEQ ID NO: 335588 - protein, 25 aa, Artificial Sequence
  Description of Artificial Sequence: Synthetic peptide
  Seed: RAMLGTHTMEVTVYHRRGSRSYVPL (PMEL_HUMAN)
  Core: MLGTHTMEV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RAXLGXHXMEXTVYHRRGSRSYVPL

SEQ ID NO: 335589 - protein, 25 aa, Artificial Sequence
  Description of Artificial Sequence: Synthetic peptide
  Seed: RAMLGTHTMEVTVYHRRGSRSYVPL (PMEL_HUMAN)
  Core: THTMEVTVY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGXHTXEXTVXHRRGSRSYVPL

SEQ ID NO: 335590 - protein, 25 aa, Artificial Sequence
  Description of Artificial Sequence: Synthetic peptide
  Seed: RAMLGTHTMEVTVYHRRGSRSYVPL (PMEL_HUMAN)
  Core: MEVTVYHRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTXEVXVXHRXGSRSYVPL

SEQ ID NO: 335591 - protein, 25 aa, Artificial Sequence
  Description of Artificial Sequence: Synthetic peptide
  Seed: RAMLGTHTMEVTVYHRRGSRSYVPL (PMEL_HUMAN)
  Core: VTVYHRRGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMEXTVXHXRGXRSYVPL

SEQ ID NO: 335592 - protein, 25 aa, Artificial Sequence
  Description of Artificial Sequence: Synthetic peptide
  Seed: RAMLGTHTMEVTVYHRRGSRSYVPL (PMEL_HUMAN)
  Core: YHRRGSRSY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RAMLGTHTMEVTVXHRXGXRSXVPL

SEQ ID NO: 335593 - protein, 13 aa, Artificial Sequence
  Description of Artificial Sequence: Synthetic peptide
  Seed: RCLLHLAVIGALL (PMEL_HUMAN)
  Core: LLHLAVIGA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RCXLHXAXIGXLL

SEQ ID NO: 335594 - protein, 13 aa, Artificial Sequence
  Description of Artificial Sequence: Synthetic peptide
  Seed: RCLLHLAVIGALL (PMEL_HUMAN)
  Core: LHLAVIGAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RCLXHLXVXGAXL

SEQ ID NO: 335595 - protein, 14 aa, Artificial Sequence
  Description of Artificial Sequence: Synthetic peptide
  Seed: RCLLHLAVIGALLA (PMEL_HUMAN)
  Core: LLHLAVIGA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RCXLHXAXIGXLLA

SEQ ID NO: 335596 - protein, 14 aa, Artificial Sequence
  Description of Artificial Sequence: Synthetic peptide
  Seed: RCLLHLAVIGALLA (PMEL_HUMAN)
  Core: LHLAVIGAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RCLXHLXVXGAXLA

SEQ ID NO: 335597 - protein, 14 aa, Artificial Sequence
  Description of Artificial Sequence: Synthetic peptide
  Seed: RCLLHLAVIGALLA (PMEL_HUMAN)
  Core: LAVIGALLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHXAVXGXLLX

SEQ ID NO: 335598 - protein, 15 aa, Artificial Sequence
  Description of Artificial Sequence: Synthetic peptide
  Seed: RCLLHLAVIGALLAV (PMEL_HUMAN)
  Core: LLHLAVIGA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RCXLHXAXIGXLLAV

SEQ ID NO: 335599 - protein, 15 aa, Artificial Sequence
  Description of Artificial Sequence: Synthetic peptide
  Seed: RCLLHLAVIGALLAV (PMEL_HUMAN)
  Core: LHLAVIGAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RCLXHLXVXGAXLAV

SEQ ID NO: 335600 - protein, 15 aa, Artificial Sequence
  Description of Artificial Sequence: Synthetic peptide
  Seed: RCLLHLAVIGALLAV (PMEL_HUMAN)
  Core: LAVIGALLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHXAVXGXLLXV

SEQ ID NO: 335601 - protein, 16 aa, Artificial Sequence
  Description of Artificial Sequence: Synthetic peptide
  Seed: RCLLHLAVIGALLAVG (PMEL_HUMAN)
  Core: LHLAVIGAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RCLXHLXVXGAXLAVG

SEQ ID NO: 335602 - protein, 16 aa, Artificial Sequence
  Description of Artificial Sequence: Synthetic peptide
  Seed: RCLLHLAVIGALLAVG (PMEL_HUMAN)
  Core: LAVIGALLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHXAVXGXLLXVG

SEQ ID NO: 335603 - protein, 16 aa, Artificial Sequence
  Description of Artificial Sequence: Synthetic peptide
  Seed: RCLLHLAVIGALLAVG (PMEL_HUMAN)
  Core: AVIGALLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLXVIXAXLAXG

SEQ ID NO: 335604 - protein, 16 aa, Artificial Sequence
  Description of Artificial Sequence: Synthetic peptide
  Seed: RCLLHLAVIGALLAVG (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVX

SEQ ID NO: 335605 - protein, 17 aa, Artificial Sequence
  Description of Artificial Sequence: Synthetic peptide
  Seed: RCLLHLAVIGALLAVGA (PMEL_HUMAN)
  Core: LHLAVIGAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RCLXHLXVXGAXLAVGA

SEQ ID NO: 335606 - protein, 17 aa, Artificial Sequence
  Description of Artificial Sequence: Synthetic peptide
  Seed: RCLLHLAVIGALLAVGA (PMEL_HUMAN)
  Core: LAVIGALLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHXAVXGXLLXVGA

SEQ ID NO: 335607 - protein, 17 aa, Artificial Sequence
  Description of Artificial Sequence: Synthetic peptide
  Seed: RCLLHLAVIGALLAVGA (PMEL_HUMAN)
  Core: AVIGALLAV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLXVIXAXLAXGA

SEQ ID NO: 335608 - protein, 17 aa, Artificial Sequence
  Description of Artificial Sequence: Synthetic peptide
  Seed: RCLLHLAVIGALLAVGA (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVXA

SEQ ID NO: 335609 - protein, 18 aa, Artificial Sequence
  Description of Artificial Sequence: Synthetic peptide
  Seed: RCLLHLAVIGALLAVGAT (PMEL_HUMAN)
  Core: LAVIGALLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHXAVXGXLLXVGAT

SEQ ID NO: 335610 - protein, 18 aa, Artificial Sequence
  Description of Artificial Sequence: Synthetic peptide
  Seed: RCLLHLAVIGALLAVGAT (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVXAT

SEQ ID NO: 335611 - protein, 18 aa, Artificial Sequence
  Description of Artificial Sequence: Synthetic peptide
  Seed: RCLLHLAVIGALLAVGAT (PMEL_HUMAN)
  Core: IGALLAVGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVXGAXLXVGXT

SEQ ID NO: 335612 - protein, 19 aa, Artificial Sequence
  Description of Artificial Sequence: Synthetic peptide
  Seed: RCLLHLAVIGALLAVGATK (PMEL_HUMAN)
  Core: LAVIGALLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHXAVXGXLLXVGATK

SEQ ID NO: 335613 - protein, 19 aa, Artificial Sequence
  Description of Artificial Sequence: Synthetic peptide
  Seed: RCLLHLAVIGALLAVGATK (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVXATK

SEQ ID NO: 335614 - protein, 19 aa, Artificial Sequence
  Description of Artificial Sequence: Synthetic peptide
  Seed: RCLLHLAVIGALLAVGATK (PMEL_HUMAN)
  Core: IGALLAVGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVXGAXLXVGXTK

SEQ ID NO: 335615 - protein, 20 aa, Artificial Sequence
  Description of Artificial Sequence: Synthetic peptide
  Seed: RCLLHLAVIGALLAVGATKV (PMEL_HUMAN)
  Core: LAVIGALLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHXAVXGXLLXVGATKV

SEQ ID NO: 335616 - protein, 20 aa, Artificial Sequence
  Description of Artificial Sequence: Synthetic peptide
  Seed: RCLLHLAVIGALLAVGATKV (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVXATKV

SEQ ID NO: 335617 - protein, 20 aa, Artificial Sequence
  Description of Artificial Sequence: Synthetic peptide
  Seed: RCLLHLAVIGALLAVGATKV (PMEL_HUMAN)
  Core: IGALLAVGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVXGAXLXVGXTKV

SEQ ID NO: 335618 - protein, 20 aa, Artificial Sequence
  Description of Artificial Sequence: Synthetic peptide
  Seed: RCLLHLAVIGALLAVGATKV (PMEL_HUMAN)
  Core: LLAVGATKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVIGAXLAXGXTKX

SEQ ID NO: 335619 - protein, 21 aa, Artificial Sequence
  Description of Artificial Sequence: Synthetic peptide
  Seed: RCLLHLAVIGALLAVGATKVP (PMEL_HUMAN)
  Core: LAVIGALLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHXAVXGXLLXVGATKVP

SEQ ID NO: 335620 - protein, 21 aa, Artificial Sequence
  Description of Artificial Sequence: Synthetic peptide
  Seed: RCLLHLAVIGALLAVGATKVP (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVXATKVP

SEQ ID NO: 335621 - protein, 21 aa, Artificial Sequence
  Description of Artificial Sequence: Synthetic peptide
  Seed: RCLLHLAVIGALLAVGATKVP (PMEL_HUMAN)
  Core: IGALLAVGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVXGAXLXVGXTKVP

SEQ ID NO: 335622 - protein, 21 aa, Artificial Sequence
  Description of Artificial Sequence: Synthetic peptide
  Seed: RCLLHLAVIGALLAVGATKVP (PMEL_HUMAN)
  Core: LLAVGATKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVIGAXLAXGXTKXP

SEQ ID NO: 335623 - protein, 22 aa, Artificial Sequence
  Description of Artificial Sequence: Synthetic peptide
  Seed: RCLLHLAVIGALLAVGATKVPR (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVXATKVPR

SEQ ID NO: 335624 - protein, 22 aa, Artificial Sequence
  Description of Artificial Sequence: Synthetic peptide
  Seed: RCLLHLAVIGALLAVGATKVPR (PMEL_HUMAN)
  Core: LLAVGATKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVIGAXLAXGXTKXPR

SEQ ID NO: 335625 - protein, 23 aa, Artificial Sequence
  Description of Artificial Sequence: Synthetic peptide
  Seed: RCLLHLAVIGALLAVGATKVPRN (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVXATKVPRN

SEQ ID NO: 335626 - protein, 23 aa, Artificial Sequence
  Description of Artificial Sequence: Synthetic peptide
  Seed: RCLLHLAVIGALLAVGATKVPRN (PMEL_HUMAN)
  Core: LLAVGATKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVIGAXLAXGXTKXPRN

SEQ ID NO: 335627 - protein, 24 aa, Artificial Sequence
  Description of Artificial Sequence: Synthetic peptide
  Seed: RCLLHLAVIGALLAVGATKVPRNQ (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVXATKVPRNQ

SEQ ID NO: 335628 - protein, 24 aa, Artificial Sequence
  Description of Artificial Sequence: Synthetic peptide
  Seed: RCLLHLAVIGALLAVGATKVPRNQ (PMEL_HUMAN)
  Core: LLAVGATKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVIGAXLAXGXTKXPRNQ

SEQ ID NO: 335629 - protein, 25 aa, Artificial Sequence
  Description of Artificial Sequence: Synthetic peptide
  Seed: RCLLHLAVIGALLAVGATKVPRNQD (PMEL_HUMAN)
  Core: VIGALLAVG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAXIGXLXAVXATKVPRNQD

SEQ ID NO: 335630 - protein, 25 aa, Artificial Sequence
  Description of Artificial Sequence: Synthetic peptide
  Seed: RCLLHLAVIGALLAVGATKVPRNQD (PMEL_HUMAN)
  Core: LLAVGATKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVIGAXLAXGXTKXPRNQD

SEQ ID NO: 335631 - protein, 25 aa, Artificial Sequence
  Description of Artificial Sequence: Synthetic peptide
  Seed: RCLLHLAVIGALLAVGATKVPRNQD (PMEL_HUMAN)
  Core: VGATKVPRN
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RCLLHLAVIGALLAXGAXKXPRXQD

SEQ ID NO: 335632 - protein, 20 aa, Artificial Sequence
  Description of Artificial Sequence: Synthetic peptide
  Seed: RELPIPEPEGPDASSIMSTE (PMEL_HUMAN)
  Core: PDASSIMST
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RELPIPEPEGXDAXSXMSXE

SEQ ID NO: 335633 - protein, 21 aa, Artificial Sequence
  Description of Artificial Sequence: Synthetic peptide
  Seed: RELPIPEPEGPDASSIMSTES (PMEL_HUMAN)
  Core: PDASSIMST
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RELPIPEPEGXDAXSXMSXES

SEQ ID NO: 335634 - protein, 22 aa, Artificial Sequence
  Description of Artificial Sequence: Synthetic peptide
  Seed: RELPIPEPEGPDASSIMSTESI (PMEL_HUMAN)
  Core: PDASSIMST
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RELPIPEPEGXDAXSXMSXESI

SEQ ID NO: 335635 - protein, 23 aa, Artificial Sequence
  Description of Artificial Sequence: Synthetic peptide
  Seed: RELPIPEPEGPDASSIMSTESIT (PMEL_HUMAN)
  Core: PDASSIMST
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RELPIPEPEGXDAXSXMSXESIT

SEQ ID NO: 335636 - protein, 24 aa, Artificial Sequence
  Description of Artificial Sequence: Synthetic peptide
  Seed: RELPIPEPEGPDASSIMSTESITG (PMEL_HUMAN)
  Core: PDASSIMST
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RELPIPEPEGXDAXSXMSXESITG

SEQ ID NO: 335637 - protein, 25 aa, Artificial Sequence
  Description of Artificial Sequence: Synthetic peptide
  Seed: RELPIPEPEGPDASSIMSTESITGS (PMEL_HUMAN)
  Core: PDASSIMST
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RELPIPEPEGXDAXSXMSXESITGS

SEQ ID NO: 335638 - protein, 19 aa, Artificial Sequence
  Description of Artificial Sequence: Synthetic peptide
  Seed: RGGQVSLKVSNDGPTLIGA (PMEL_HUMAN)
  Core: VSNDGPTLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKXSNXGXTLXGA

SEQ ID NO: 335639 - protein, 20 aa, Artificial Sequence
  Description of Artificial Sequence: Synthetic peptide
  Seed: RGGQVSLKVSNDGPTLIGAN (PMEL_HUMAN)
  Core: LKVSNDGPT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSXKVXNXGPXLIGAN

SEQ ID NO: 335640 - protein, 20 aa, Artificial Sequence
  Description of Artificial Sequence: Synthetic peptide
  Seed: RGGQVSLKVSNDGPTLIGAN (PMEL_HUMAN)
  Core: VSNDGPTLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKXSNXGXTLXGAN

SEQ ID NO: 335641 - protein, 21 aa, Artificial Sequence
  Description of Artificial Sequence: Synthetic peptide
  Seed: RGGQVSLKVSNDGPTLIGANA (PMEL_HUMAN)
  Core: VSNDGPTLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKXSNXGXTLXGANA

SEQ ID NO: 335642 - protein, 22 aa, Artificial Sequence
  Description of Artificial Sequence: Synthetic peptide
  Seed: RGGQVSLKVSNDGPTLIGANAS (PMEL_HUMAN)
  Core: VSNDGPTLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKXSNXGXTLXGANAS

SEQ ID NO: 335643 - protein, 23 aa, Artificial Sequence
  Description of Artificial Sequence: Synthetic peptide
  Seed: RGGQVSLKVSNDGPTLIGANASF (PMEL_HUMAN)
  Core: VSNDGPTLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKXSNXGXTLXGANASF

SEQ ID NO: 335644 - protein, 24 aa, Artificial Sequence
  Description of Artificial Sequence: Synthetic peptide
  Seed: RGGQVSLKVSNDGPTLIGANASFS (PMEL_HUMAN)
  Core: LKVSNDGPT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSXKVXNXGPXLIGANASFS

SEQ ID NO: 335645 - protein, 24 aa, Artificial Sequence
  Description of Artificial Sequence: Synthetic peptide
  Seed: RGGQVSLKVSNDGPTLIGANASFS (PMEL_HUMAN)
  Core: VSNDGPTLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKXSNXGXTLXGANASFS

SEQ ID NO: 335646 - protein, 24 aa, Artificial Sequence
  Description of Artificial Sequence: Synthetic peptide
  Seed: RGGQVSLKVSNDGPTLIGANASFS (PMEL_HUMAN)
  Core: PTLIGANAS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKVSNDGXTLXGXNAXFS

SEQ ID NO: 335647 - protein, 24 aa, Artificial Sequence
  Description of Artificial Sequence: Synthetic peptide
  Seed: RGGQVSLKVSNDGPTLIGANASFS (PMEL_HUMAN)
  Core: LIGANASFS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKVSNDGPTXIGXNXSFX

SEQ ID NO: 335648 - protein, 25 aa, Artificial Sequence
  Description of Artificial Sequence: Synthetic peptide
  Seed: RGGQVSLKVSNDGPTLIGANASFSI (PMEL_HUMAN)
  Core: QVSLKVSND
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGGXVSXKXSNXGPTLIGANASFSI

SEQ ID NO: 335649 - protein, 25 aa, Artificial Sequence
  Description of Artificial Sequence: Synthetic peptide
  Seed: RGGQVSLKVSNDGPTLIGANASFSI (PMEL_HUMAN)
  Core: LKVSNDGPT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSXKVXNXGPXLIGANASFSI

SEQ ID NO: 335650 - protein, 25 aa, Artificial Sequence
  Description of Artificial Sequence: Synthetic peptide
  Seed: RGGQVSLKVSNDGPTLIGANASFSI (PMEL_HUMAN)
  Core: VSNDGPTLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKXSNXGXTLXGANASFSI

SEQ ID NO: 335651 - protein, 25 aa, Artificial Sequence
  Description of Artificial Sequence: Synthetic peptide
  Seed: RGGQVSLKVSNDGPTLIGANASFSI (PMEL_HUMAN)
  Core: PTLIGANAS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKVSNDGXTLXGXNAXFSI

SEQ ID NO: 335652 - protein, 25 aa, Artificial Sequence
  Description of Artificial Sequence: Synthetic peptide
  Seed: RGGQVSLKVSNDGPTLIGANASFSI (PMEL_HUMAN)
  Core: LIGANASFS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RGGQVSLKVSNDGPTXIGXNXSFXI

SEQ ID NO: 335653 - protein, 13 aa, Artificial Sequence
  Description of Artificial Sequence: Synthetic peptide
  Seed: RGSRSYVPLAHSS (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXS

SEQ ID NO: 335654 - protein, 14 aa, Artificial Sequence
  Description of Artificial Sequence: Synthetic peptide
  Seed: RGSRSYVPLAHSSS (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSS

SEQ ID NO: 335655 - protein, 14 aa, Artificial Sequence
  Description of Artificial Sequence: Synthetic peptide
  Seed: RGSRSYVPLAHSSS (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSX

SEQ ID NO: 335656 - protein, 15 aa, Artificial Sequence
  Description of Artificial Sequence: Synthetic peptide
  Seed: RGSRSYVPLAHSSSA (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSA

SEQ ID NO: 335657 - protein, 15 aa, Artificial Sequence
  Description of Artificial Sequence: Synthetic peptide
  Seed: RGSRSYVPLAHSSSA (PMEL_HUMAN)
  Core: SYVPLAHSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RGSRXYVXLXHSXSA

SEQ ID NO: 335658 - protein, 15 aa, Artificial Sequence
  Description of Artificial Sequence: Synthetic peptide
  Seed: RGSRSYVPLAHSSSA (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXA

SEQ ID NO: 335659 - protein, 16 aa, Artificial Sequence
  Description of Artificial Sequence: Synthetic peptide
  Seed: RGSRSYVPLAHSSSAF (PMEL_HUMAN)
  Core: SRSYVPLAH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RGXRSXVXLAXSSSAF

SEQ ID NO: 335660 - protein, 16 aa, Artificial Sequence
  Description of Artificial Sequence: Synthetic peptide
  Seed: RGSRSYVPLAHSSSAF (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAF

SEQ ID NO: 335661 - protein, 16 aa, Artificial Sequence
  Description of Artificial Sequence: Synthetic peptide
  Seed: RGSRSYVPLAHSSSAF (PMEL_HUMAN)
  Core: SYVPLAHSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RGSRXYVXLXHSXSAF

SEQ ID NO: 335662 - protein, 16 aa, Artificial Sequence
  Description of Artificial Sequence: Synthetic peptide
  Seed: RGSRSYVPLAHSSSAF (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAF

SEQ ID NO: 335663 - protein, 16 aa, Artificial Sequence
  Description of Artificial Sequence: Synthetic peptide
  Seed: RGSRSYVPLAHSSSAF (PMEL_HUMAN)
  Core: VPLAHSSSA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYXPLXHXSSXF

SEQ ID NO: 335664 - protein, 17 aa, Artificial Sequence
  Description of Artificial Sequence: Synthetic peptide
  Seed: RGSRSYVPLAHSSSAFT (PMEL_HUMAN)
  Core: SRSYVPLAH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RGXRSXVXLAXSSSAFT

SEQ ID NO: 335665 - protein, 17 aa, Artificial Sequence
  Description of Artificial Sequence: Synthetic peptide
  Seed: RGSRSYVPLAHSSSAFT (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAFT

SEQ ID NO: 335666 - protein, 17 aa, Artificial Sequence
  Description of Artificial Sequence: Synthetic peptide
  Seed: RGSRSYVPLAHSSSAFT (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAFT

SEQ ID NO: 335667 - protein, 17 aa, Artificial Sequence
  Description of Artificial Sequence: Synthetic peptide
  Seed: RGSRSYVPLAHSSSAFT (PMEL_HUMAN)
  Core: VPLAHSSSA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYXPLXHXSSXFT

SEQ ID NO: 335668 - protein, 17 aa, Artificial Sequence
  Description of Artificial Sequence: Synthetic peptide
  Seed: RGSRSYVPLAHSSSAFT (PMEL_HUMAN)
  Core: LAHSSSAFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPXAHXSXAFX

SEQ ID NO: 335669 - protein, 18 aa, Artificial Sequence
  Description of Artificial Sequence: Synthetic peptide
  Seed: RGSRSYVPLAHSSSAFTI (PMEL_HUMAN)
  Core: SRSYVPLAH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RGXRSXVXLAXSSSAFTI

SEQ ID NO: 335670 - protein, 18 aa, Artificial Sequence
  Description of Artificial Sequence: Synthetic peptide
  Seed: RGSRSYVPLAHSSSAFTI (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAFTI

SEQ ID NO: 335671 - protein, 18 aa, Artificial Sequence
  Description of Artificial Sequence: Synthetic peptide
  Seed: RGSRSYVPLAHSSSAFTI (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAFTI

SEQ ID NO: 335672 - protein, 18 aa, Artificial Sequence
  Description of Artificial Sequence: Synthetic peptide
  Seed: RGSRSYVPLAHSSSAFTI (PMEL_HUMAN)
  Core: LAHSSSAFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPXAHXSXAFXI

SEQ ID NO: 335673 - protein, 19 aa, Artificial Sequence
  Description of Artificial Sequence: Synthetic peptide
  Seed: RGSRSYVPLAHSSSAFTIT (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAFTIT

SEQ ID NO: 335674 - protein, 19 aa, Artificial Sequence
  Description of Artificial Sequence: Synthetic peptide
  Seed: RGSRSYVPLAHSSSAFTIT (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAFTIT

SEQ ID NO: 335675 - protein, 19 aa, Artificial Sequence
  Description of Artificial Sequence: Synthetic peptide
  Seed: RGSRSYVPLAHSSSAFTIT (PMEL_HUMAN)
  Core: LAHSSSAFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPXAHXSXAFXIT

SEQ ID NO: 335676 - protein, 19 aa, Artificial Sequence
  Description of Artificial Sequence: Synthetic peptide
  Seed: RGSRSYVPLAHSSSAFTIT (PMEL_HUMAN)
  Core: AHSSSAFTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLXHSXSXFTXT

SEQ ID NO: 335677 - protein, 20 aa, Artificial Sequence
  Description of Artificial Sequence: Synthetic peptide
  Seed: RGSRSYVPLAHSSSAFTITD (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAFTITD

SEQ ID NO: 335678 - protein, 20 aa, Artificial Sequence
  Description of Artificial Sequence: Synthetic peptide
  Seed: RGSRSYVPLAHSSSAFTITD (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAFTITD

SEQ ID NO: 335679 - protein, 20 aa, Artificial Sequence
  Description of Artificial Sequence: Synthetic peptide
  Seed: RGSRSYVPLAHSSSAFTITD (PMEL_HUMAN)
  Core: LAHSSSAFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPXAHXSXAFXITD

SEQ ID NO: 335680 - protein, 20 aa, Artificial Sequence
  Description of Artificial Sequence: Synthetic peptide
  Seed: RGSRSYVPLAHSSSAFTITD (PMEL_HUMAN)
  Core: AHSSSAFTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLXHSXSXFTXTD

SEQ ID NO: 335681 - protein, 21 aa, Artificial Sequence
  Description of Artificial Sequence: Synthetic peptide
  Seed: RGSRSYVPLAHSSSAFTITDQ (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAFTITDQ

SEQ ID NO: 335682 - protein, 21 aa, Artificial Sequence
  Description of Artificial Sequence: Synthetic peptide
  Seed: RGSRSYVPLAHSSSAFTITDQ (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAFTITDQ

SEQ ID NO: 335683 - protein, 21 aa, Artificial Sequence
  Description of Artificial Sequence: Synthetic peptide
  Seed: RGSRSYVPLAHSSSAFTITDQ (PMEL_HUMAN)
  Core: LAHSSSAFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPXAHXSXAFXITDQ

SEQ ID NO: 335684 - protein, 21 aa, Artificial Sequence
  Description of Artificial Sequence: Synthetic peptide
  Seed: RGSRSYVPLAHSSSAFTITDQ (PMEL_HUMAN)
  Core: AHSSSAFTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLXHSXSXFTXTDQ

SEQ ID NO: 335685 - protein, 22 aa, Artificial Sequence
  Description of Artificial Sequence: Synthetic peptide
  Seed: RGSRSYVPLAHSSSAFTITDQV (PMEL_HUMAN)
  Core: SRSYVPLAH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RGXRSXVXLAXSSSAFTITDQV

SEQ ID NO: 335686 - protein, 22 aa, Artificial Sequence
  Description of Artificial Sequence: Synthetic peptide
  Seed: RGSRSYVPLAHSSSAFTITDQV (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAFTITDQV

SEQ ID NO: 335687 - protein, 22 aa, Artificial Sequence
  Description of Artificial Sequence: Synthetic peptide
  Seed: RGSRSYVPLAHSSSAFTITDQV (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAFTITDQV

SEQ ID NO: 335688 - protein, 22 aa, Artificial Sequence
  Description of Artificial Sequence: Synthetic peptide
  Seed: RGSRSYVPLAHSSSAFTITDQV (PMEL_HUMAN)
  Core: LAHSSSAFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPXAHXSXAFXITDQV

SEQ ID NO: 335689 - protein, 22 aa, Artificial Sequence
  Description of Artificial Sequence: Synthetic peptide
  Seed: RGSRSYVPLAHSSSAFTITDQV (PMEL_HUMAN)
  Core: AHSSSAFTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLXHSXSXFTXTDQV

SEQ ID NO: 335690 - protein, 23 aa, Artificial Sequence
  Description of Artificial Sequence: Synthetic peptide
  Seed: RGSRSYVPLAHSSSAFTITDQVP (PMEL_HUMAN)
  Core: SRSYVPLAH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RGXRSXVXLAXSSSAFTITDQVP

SEQ ID NO: 335691 - protein, 23 aa, Artificial Sequence
  Description of Artificial Sequence: Synthetic peptide
  Seed: RGSRSYVPLAHSSSAFTITDQVP (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAFTITDQVP

SEQ ID NO: 335692 - protein, 23 aa, Artificial Sequence
  Description of Artificial Sequence: Synthetic peptide
  Seed: RGSRSYVPLAHSSSAFTITDQVP (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAFTITDQVP

SEQ ID NO: 335693 - protein, 23 aa, Artificial Sequence
  Description of Artificial Sequence: Synthetic peptide
  Seed: RGSRSYVPLAHSSSAFTITDQVP (PMEL_HUMAN)
  Core: LAHSSSAFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPXAHXSXAFXITDQVP

SEQ ID NO: 335694 - protein, 23 aa, Artificial Sequence
  Description of Artificial Sequence: Synthetic peptide
  Seed: RGSRSYVPLAHSSSAFTITDQVP (PMEL_HUMAN)
  Core: AHSSSAFTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLXHSXSXFTXTDQVP

SEQ ID NO: 335695 - protein, 23 aa, Artificial Sequence
  Description of Artificial Sequence: Synthetic peptide
  Seed: RGSRSYVPLAHSSSAFTITDQVP (PMEL_HUMAN)
  Core: SSSAFTITD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLAHXSSXFXITXQVP

SEQ ID NO: 335696 - protein, 23 aa, Artificial Sequence
  Description of Artificial Sequence: Synthetic peptide
  Seed: RGSRSYVPLAHSSSAFTITDQVP (PMEL_HUMAN)
  Core: SSAFTITDQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLAHSXSAXTXTDXVP

SEQ ID NO: 335697 - protein, 24 aa, Artificial Sequence
  Description of Artificial Sequence: Synthetic peptide
  Seed: RGSRSYVPLAHSSSAFTITDQVPF (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAFTITDQVPF

SEQ ID NO: 335698 - protein, 24 aa, Artificial Sequence
  Description of Artificial Sequence: Synthetic peptide
  Seed: RGSRSYVPLAHSSSAFTITDQVPF (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAFTITDQVPF

SEQ ID NO: 335699 - protein, 24 aa, Artificial Sequence
  Description of Artificial Sequence: Synthetic peptide
  Seed: RGSRSYVPLAHSSSAFTITDQVPF (PMEL_HUMAN)
  Core: LAHSSSAFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPXAHXSXAFXITDQVPF

SEQ ID NO: 335700 - protein, 24 aa, Artificial Sequence
  Description of Artificial Sequence: Synthetic peptide
  Seed: RGSRSYVPLAHSSSAFTITDQVPF (PMEL_HUMAN)
  Core: AHSSSAFTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLXHSXSXFTXTDQVPF

SEQ ID NO: 335701 - protein, 24 aa, Artificial Sequence
  Description of Artificial Sequence: Synthetic peptide
  Seed: RGSRSYVPLAHSSSAFTITDQVPF (PMEL_HUMAN)
  Core: HSSSAFTIT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLAXSSXAXTIXDQVPF

SEQ ID NO: 335702 - protein, 24 aa, Artificial Sequence
  Description of Artificial Sequence: Synthetic peptide
  Seed: RGSRSYVPLAHSSSAFTITDQVPF (PMEL_HUMAN)
  Core: SSSAFTITD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLAHXSSXFXITXQVPF

SEQ ID NO: 335703 - protein, 24 aa, Artificial Sequence
  Description of Artificial Sequence: Synthetic peptide
  Seed: RGSRSYVPLAHSSSAFTITDQVPF (PMEL_HUMAN)
  Core: SSAFTITDQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLAHSXSAXTXTDXVPF

SEQ ID NO: 335704 - protein, 25 aa, Artificial Sequence
  Description of Artificial Sequence: Synthetic peptide
  Seed: RGSRSYVPLAHSSSAFTITDQVPFS (PMEL_HUMAN)
  Core: RSYVPLAHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RGSXSYXPXAHXSSAFTITDQVPFS

SEQ ID NO: 335705 - protein, 25 aa, Artificial Sequence
  Description of Artificial Sequence: Synthetic peptide
  Seed: RGSRSYVPLAHSSSAFTITDQVPFS (PMEL_HUMAN)
  Core: YVPLAHSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSXVPXAXSSXAFTITDQVPFS

SEQ ID NO: 335706 - protein, 25 aa, Artificial Sequence
  Description of Artificial Sequence: Synthetic peptide
  Seed: RGSRSYVPLAHSSSAFTITDQVPFS (PMEL_HUMAN)
  Core: LAHSSSAFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPXAHXSXAFXITDQVPFS

SEQ ID NO: 335707 - protein, 25 aa, Artificial Sequence
  Description of Artificial Sequence: Synthetic peptide
  Seed: RGSRSYVPLAHSSSAFTITDQVPFS (PMEL_HUMAN)
  Core: AHSSSAFTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLXHSXSXFTXTDQVPFS

SEQ ID NO: 335708 - protein, 25 aa, Artificial Sequence
  Description of Artificial Sequence: Synthetic peptide
  Seed: RGSRSYVPLAHSSSAFTITDQVPFS (PMEL_HUMAN)
  Core: HSSSAFTIT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLAXSSXAXTIXDQVPFS

SEQ ID NO: 335709 - protein, 25 aa, Artificial Sequence
  Description of Artificial Sequence: Synthetic peptide
  Seed: RGSRSYVPLAHSSSAFTITDQVPFS (PMEL_HUMAN)
  Core: SSAFTITDQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLAHSXSAXTXTDXVPFS

SEQ ID NO: 335710 - protein, 25 aa, Artificial Sequence
  Description of Artificial Sequence: Synthetic peptide
  Seed: RGSRSYVPLAHSSSAFTITDQVPFS (PMEL_HUMAN)
  Core: SAFTITDQV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLAHSSXAFXIXDQXPFS

SEQ ID NO: 335711 - protein, 25 aa, Artificial Sequence
  Description of Artificial Sequence: Synthetic peptide
  Seed: RGSRSYVPLAHSSSAFTITDQVPFS (PMEL_HUMAN)
  Core: FTITDQVPF
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RGSRSYVPLAHSSSAXTIXDXVPXS

SEQ ID NO: 335712 - protein, 15 aa, Artificial Sequence
  Description of Artificial Sequence: Synthetic peptide
  Seed: RLCQPVLPSPACQLV (PMEL_HUMAN)
  Core: CQPVLPSPA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXQPXLXSPXCQLV

SEQ ID NO: 335713 - protein, 15 aa, Artificial Sequence
  Description of Artificial Sequence: Synthetic peptide
  Seed: RLCQPVLPSPACQLV (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXV

SEQ ID NO: 335714 - protein, 16 aa, Artificial Sequence
  Description of Artificial Sequence: Synthetic peptide
  Seed: RLCQPVLPSPACQLVL (PMEL_HUMAN)
  Core: CQPVLPSPA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXQPXLXSPXCQLVL

SEQ ID NO: 335715 - protein, 16 aa, Artificial Sequence
  Description of Artificial Sequence: Synthetic peptide
  Seed: RLCQPVLPSPACQLVL (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXVL

SEQ ID NO: 335716 - protein, 17 aa, Artificial Sequence
  Description of Artificial Sequence: Synthetic peptide
  Seed: RLCQPVLPSPACQLVLH (PMEL_HUMAN)
  Core: CQPVLPSPA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXQPXLXSPXCQLVLH

SEQ ID NO: 335717 - protein, 17 aa, Artificial Sequence
  Description of Artificial Sequence: Synthetic peptide
  Seed: RLCQPVLPSPACQLVLH (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXVLH

SEQ ID NO: 335718 - protein, 19 aa, Artificial Sequence
  Description of Artificial Sequence: Synthetic peptide
  Seed: RLCQPVLPSPACQLVLHQI (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXVLHQI

SEQ ID NO: 335719 - protein, 20 aa, Artificial Sequence
  Description of Artificial Sequence: Synthetic peptide
  Seed: RLCQPVLPSPACQLVLHQIL (PMEL_HUMAN)
  Core: CQPVLPSPA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXQPXLXSPXCQLVLHQIL

SEQ ID NO: 335720 - protein, 20 aa, Artificial Sequence
  Description of Artificial Sequence: Synthetic peptide
  Seed: RLCQPVLPSPACQLVLHQIL (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXVLHQIL

SEQ ID NO: 335721 - protein, 21 aa, Artificial Sequence
  Description of Artificial Sequence: Synthetic peptide
  Seed: RLCQPVLPSPACQLVLHQILK (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXVLHQILK

SEQ ID NO: 335722 - protein, 21 aa, Artificial Sequence
  Description of Artificial Sequence: Synthetic peptide
  Seed: RLCQPVLPSPACQLVLHQILK (PMEL_HUMAN)
  Core: PACQLVLHQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSXACXLXLHXILK

SEQ ID NO: 335723 - protein, 21 aa, Artificial Sequence
  Description of Artificial Sequence: Synthetic peptide
  Seed: RLCQPVLPSPACQLVLHQILK (PMEL_HUMAN)
  Core: CQLVLHQIL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPAXQLXLXQIXK

SEQ ID NO: 335724 - protein, 22 aa, Artificial Sequence
  Description of Artificial Sequence: Synthetic peptide
  Seed: RLCQPVLPSPACQLVLHQILKG (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXVLHQILKG

SEQ ID NO: 335725 - protein, 22 aa, Artificial Sequence
  Description of Artificial Sequence: Synthetic peptide
  Seed: RLCQPVLPSPACQLVLHQILKG (PMEL_HUMAN)
  Core: PACQLVLHQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSXACXLXLHXILKG

SEQ ID NO: 335726 - protein, 22 aa, Artificial Sequence
  Description of Artificial Sequence: Synthetic peptide
  Seed: RLCQPVLPSPACQLVLHQILKG (PMEL_HUMAN)
  Core: ACQLVLHQI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPXCQXVXHQXLKG

SEQ ID NO: 335727 - protein, 22 aa, Artificial Sequence
  Description of Artificial Sequence: Synthetic peptide
  Seed: RLCQPVLPSPACQLVLHQILKG (PMEL_HUMAN)
  Core: CQLVLHQIL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPAXQLXLXQIXKG

SEQ ID NO: 335728 - protein, 22 aa, Artificial Sequence
  Description of Artificial Sequence: Synthetic peptide
  Seed: RLCQPVLPSPACQLVLHQILKG (PMEL_HUMAN)
  Core: LVLHQILKG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPACQXVLXQXLKX

SEQ ID NO: 335729 - protein, 23 aa, Artificial Sequence
  Description of Artificial Sequence: Synthetic peptide
  Seed: RLCQPVLPSPACQLVLHQILKGG (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXVLHQILKGG

SEQ ID NO: 335730 - protein, 23 aa, Artificial Sequence
  Description of Artificial Sequence: Synthetic peptide
  Seed: RLCQPVLPSPACQLVLHQILKGG (PMEL_HUMAN)
  Core: CQLVLHQIL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPAXQLXLXQIXKGG

SEQ ID NO: 335731 - protein, 23 aa, Artificial Sequence
  Description of Artificial Sequence: Synthetic peptide
  Seed: RLCQPVLPSPACQLVLHQILKGG (PMEL_HUMAN)
  Core: LVLHQILKG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPACQXVLXQXLKXG

SEQ ID NO: 335732 - protein, 24 aa, Artificial Sequence
  Description of Artificial Sequence: Synthetic peptide
  Seed: RLCQPVLPSPACQLVLHQILKGGS (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXVLHQILKGGS

SEQ ID NO: 335733 - protein, 24 aa, Artificial Sequence
  Description of Artificial Sequence: Synthetic peptide
  Seed: RLCQPVLPSPACQLVLHQILKGGS (PMEL_HUMAN)
  Core: CQLVLHQIL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPAXQLXLXQIXKGGS

SEQ ID NO: 335734 - protein, 24 aa, Artificial Sequence
  Description of Artificial Sequence: Synthetic peptide
  Seed: RLCQPVLPSPACQLVLHQILKGGS (PMEL_HUMAN)
  Core: LVLHQILKG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPACQXVLXQXLKXGS

SEQ ID NO: 335735 - protein, 25 aa, Artificial Sequence
  Description of Artificial Sequence: Synthetic peptide
  Seed: RLCQPVLPSPACQLVLHQILKGGSG (PMEL_HUMAN)
  Core: VLPSPACQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPXLPXPXCQXVLHQILKGGSG

SEQ ID NO: 335736 - protein, 25 aa, Artificial Sequence
  Description of Artificial Sequence: Synthetic peptide
  Seed: RLCQPVLPSPACQLVLHQILKGGSG (PMEL_HUMAN)
  Core: CQLVLHQIL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPAXQLXLXQIXKGGSG

SEQ ID NO: 335737 - protein, 25 aa, Artificial Sequence
  Description of Artificial Sequence: Synthetic peptide
  Seed: RLCQPVLPSPACQLVLHQILKGGSG (PMEL_HUMAN)
  Core: LVLHQILKG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPACQXVLXQXLKXGSG

SEQ ID NO: 335738 - protein, 25 aa, Artificial Sequence
  Description of Artificial Sequence: Synthetic peptide
  Seed: RLCQPVLPSPACQLVLHQILKGGSG (PMEL_HUMAN)
  Core: LHQILKGGS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RLCQPVLPSPACQLVXHQXLXGGXG

SEQ ID NO: 335739 - protein, 14 aa, Artificial Sequence
  Description of Artificial Sequence: Synthetic peptide
  Seed: RLDCWRGGQVSLKV (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXV

SEQ ID NO: 335740 - protein, 15 aa, Artificial Sequence
  Description of Artificial Sequence: Synthetic peptide
  Seed: RLDCWRGGQVSLKVS (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVS

SEQ ID NO: 335741 - protein, 16 aa, Artificial Sequence
  Description of Artificial Sequence: Synthetic peptide
  Seed: RLDCWRGGQVSLKVSN (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSN

SEQ ID NO: 335742 - protein, 17 aa, Artificial Sequence
  Description of Artificial Sequence: Synthetic peptide
  Seed: RLDCWRGGQVSLKVSND (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSND

SEQ ID NO: 335743 - protein, 18 aa, Artificial Sequence
  Description of Artificial Sequence: Synthetic peptide
  Seed: RLDCWRGGQVSLKVSNDG (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSNDG

SEQ ID NO: 335744 - protein, 19 aa, Artificial Sequence
  Description of Artificial Sequence: Synthetic peptide
  Seed: RLDCWRGGQVSLKVSNDGP (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSNDGP

SEQ ID NO: 335745 - protein, 20 aa, Artificial Sequence
  Description of Artificial Sequence: Synthetic peptide
  Seed: RLDCWRGGQVSLKVSNDGPT (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSNDGPT

SEQ ID NO: 335746 - protein, 20 aa, Artificial Sequence
  Description of Artificial Sequence: Synthetic peptide
  Seed: RLDCWRGGQVSLKVSNDGPT (PMEL_HUMAN)
  Core: QVSLKVSND
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLDCWRGGXVSXKXSNXGPT

SEQ ID NO: 335747 - protein, 21 aa, Artificial Sequence
  Description of Artificial Sequence: Synthetic peptide
  Seed: RLDCWRGGQVSLKVSNDGPTL (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSNDGPTL

SEQ ID NO: 335748 - protein, 22 aa, Artificial Sequence
  Description of Artificial Sequence: Synthetic peptide
  Seed: RLDCWRGGQVSLKVSNDGPTLI (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSNDGPTLI

SEQ ID NO: 335749 - protein, 22 aa, Artificial Sequence
  Description of Artificial Sequence: Synthetic peptide
  Seed: RLDCWRGGQVSLKVSNDGPTLI (PMEL_HUMAN)
  Core: QVSLKVSND
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLDCWRGGXVSXKXSNXGPTLI

SEQ ID NO: 335750 - protein, 23 aa, Artificial Sequence
  Description of Artificial Sequence: Synthetic peptide
  Seed: RLDCWRGGQVSLKVSNDGPTLIG (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSNDGPTLIG

SEQ ID NO: 335751 - protein, 23 aa, Artificial Sequence
  Description of Artificial Sequence: Synthetic peptide
  Seed: RLDCWRGGQVSLKVSNDGPTLIG (PMEL_HUMAN)
  Core: QVSLKVSND
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLDCWRGGXVSXKXSNXGPTLIG

SEQ ID NO: 335752 - protein, 24 aa, Artificial Sequence
  Description of Artificial Sequence: Synthetic peptide
  Seed: RLDCWRGGQVSLKVSNDGPTLIGA (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSNDGPTLIGA

SEQ ID NO: 335753 - protein, 24 aa, Artificial Sequence
  Description of Artificial Sequence: Synthetic peptide
  Seed: RLDCWRGGQVSLKVSNDGPTLIGA (PMEL_HUMAN)
  Core: QVSLKVSND
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLDCWRGGXVSXKXSNXGPTLIGA

SEQ ID NO: 335754 - protein, 24 aa, Artificial Sequence
  Description of Artificial Sequence: Synthetic peptide
  Seed: RLDCWRGGQVSLKVSNDGPTLIGA (PMEL_HUMAN)
  Core: VSNDGPTLI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLDCWRGGQVSLKXSNXGXTLXGA

SEQ ID NO: 335755 - protein, 25 aa, Artificial Sequence
  Description of Artificial Sequence: Synthetic peptide
  Seed: RLDCWRGGQVSLKVSNDGPTLIGAN (PMEL_HUMAN)
  Core: WRGGQVSLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLDCXRGXQXSLXVSNDGPTLIGAN

SEQ ID NO: 335756 - protein, 25 aa, Artificial Sequence
  Description of Artificial Sequence: Synthetic peptide
  Seed: RLDCWRGGQVSLKVSNDGPTLIGAN (PMEL_HUMAN)
  Core: QVSLKVSND
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLDCWRGGXVSXKXSNXGPTLIGAN

SEQ ID NO: 335757 - protein, 25 aa, Artificial Sequence
  Description of Artificial Sequence: Synthetic peptide
  Seed: RLDCWRGGQVSLKVSNDGPTLIGAN (PMEL_HUMAN)
  Core: VSNDGPTLI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLDCWRGGQVSLKXSNXGXTLXGAN

SEQ ID NO: 335758 - protein, 14 aa, Artificial Sequence
  Description of Artificial Sequence: Synthetic peptide
  Seed: RLMKQDFSVPQLPH (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPH

SEQ ID NO: 335759 - protein, 15 aa, Artificial Sequence
  Description of Artificial Sequence: Synthetic peptide
  Seed: RLMKQDFSVPQLPHS (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHS

SEQ ID NO: 335760 - protein, 15 aa, Artificial Sequence
  Description of Artificial Sequence: Synthetic peptide
  Seed: RLMKQDFSVPQLPHS (PMEL_HUMAN)
  Core: KQDFSVPQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLMXQDXSXPQXPHS

SEQ ID NO: 335761 - protein, 15 aa, Artificial Sequence
  Description of Artificial Sequence: Synthetic peptide
  Seed: RLMKQDFSVPQLPHS (PMEL_HUMAN)
  Core: FSVPQLPHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDXSVXQXPHX

SEQ ID NO: 335762 - protein, 16 aa, Artificial Sequence
  Description of Artificial Sequence: Synthetic peptide
  Seed: RLMKQDFSVPQLPHSS (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHSS

SEQ ID NO: 335763 - protein, 16 aa, Artificial Sequence
  Description of Artificial Sequence: Synthetic peptide
  Seed: RLMKQDFSVPQLPHSS (PMEL_HUMAN)
  Core: KQDFSVPQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLMXQDXSXPQXPHSS

SEQ ID NO: 335764 - protein, 16 aa, Artificial Sequence
  Description of Artificial Sequence: Synthetic peptide
  Seed: RLMKQDFSVPQLPHSS (PMEL_HUMAN)
  Core: FSVPQLPHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDXSVXQXPHXS

SEQ ID NO: 335765 - protein, 17 aa, Artificial Sequence
  Description of Artificial Sequence: Synthetic peptide
  Seed: RLMKQDFSVPQLPHSSS (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHSSS

SEQ ID NO: 335766 - protein, 17 aa, Artificial Sequence
  Description of Artificial Sequence: Synthetic peptide
  Seed: RLMKQDFSVPQLPHSSS (PMEL_HUMAN)
  Core: KQDFSVPQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLMXQDXSXPQXPHSSS

SEQ ID NO: 335767 - protein, 17 aa, Artificial Sequence
  Description of Artificial Sequence: Synthetic peptide
  Seed: RLMKQDFSVPQLPHSSS (PMEL_HUMAN)
  Core: FSVPQLPHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDXSVXQXPHXSS

SEQ ID NO: 335768 - protein, 19 aa, Artificial Sequence
  Description of Artificial Sequence: Synthetic peptide
  Seed: RLMKQDFSVPQLPHSSSHW (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHSSSHW

SEQ ID NO: 335769 - protein, 20 aa, Artificial Sequence
  Description of Artificial Sequence: Synthetic peptide
  Seed: RLMKQDFSVPQLPHSSSHWL (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHSSSHWL

SEQ ID NO: 335770 - protein, 20 aa, Artificial Sequence
  Description of Artificial Sequence: Synthetic peptide
  Seed: RLMKQDFSVPQLPHSSSHWL (PMEL_HUMAN)
  Core: FSVPQLPHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDXSVXQXPHXSSHWL

SEQ ID NO: 335771 - protein, 21 aa, Artificial Sequence
  Description of Artificial Sequence: Synthetic peptide
  Seed: RLMKQDFSVPQLPHSSSHWLR (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHSSSHWLR

SEQ ID NO: 335772 - protein, 22 aa, Artificial Sequence
  Description of Artificial Sequence: Synthetic peptide
  Seed: RLMKQDFSVPQLPHSSSHWLRL (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHSSSHWLRL

SEQ ID NO: 335773 - protein, 22 aa, Artificial Sequence
  Description of Artificial Sequence: Synthetic peptide
  Seed: RLMKQDFSVPQLPHSSSHWLRL (PMEL_HUMAN)
  Core: FSVPQLPHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDXSVXQXPHXSSHWLRL

SEQ ID NO: 335774 - protein, 23 aa, Artificial Sequence
  Description of Artificial Sequence: Synthetic peptide
  Seed: RLMKQDFSVPQLPHSSSHWLRLP (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHSSSHWLRLP

SEQ ID NO: 335775 - protein, 23 aa, Artificial Sequence
  Description of Artificial Sequence: Synthetic peptide
  Seed: RLMKQDFSVPQLPHSSSHWLRLP (PMEL_HUMAN)
  Core: KQDFSVPQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLMXQDXSXPQXPHSSSHWLRLP

SEQ ID NO: 335776 - protein, 23 aa, Artificial Sequence
  Description of Artificial Sequence: Synthetic peptide
  Seed: RLMKQDFSVPQLPHSSSHWLRLP (PMEL_HUMAN)
  Core: FSVPQLPHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDXSVXQXPHXSSHWLRLP

SEQ ID NO: 335777 - protein, 23 aa, Artificial Sequence
  Description of Artificial Sequence: Synthetic peptide
  Seed: RLMKQDFSVPQLPHSSSHWLRLP (PMEL_HUMAN)
  Core: HSSSHWLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDFSVPQLPXSSXHXLRXP

SEQ ID NO: 335778 - protein, 24 aa, Artificial Sequence
  Description of Artificial Sequence: Synthetic peptide
  Seed: RLMKQDFSVPQLPHSSSHWLRLPR (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHSSSHWLRLPR

SEQ ID NO: 335779 - protein, 24 aa, Artificial Sequence
  Description of Artificial Sequence: Synthetic peptide
  Seed: RLMKQDFSVPQLPHSSSHWLRLPR (PMEL_HUMAN)
  Core: FSVPQLPHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDXSVXQXPHXSSHWLRLPR

SEQ ID NO: 335780 - protein, 24 aa, Artificial Sequence
  Description of Artificial Sequence: Synthetic peptide
  Seed: RLMKQDFSVPQLPHSSSHWLRLPR (PMEL_HUMAN)
  Core: PHSSSHWLR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDFSVPQLXHSXSXWLXLPR

SEQ ID NO: 335781 - protein, 24 aa, Artificial Sequence
  Description of Artificial Sequence: Synthetic peptide
  Seed: RLMKQDFSVPQLPHSSSHWLRLPR (PMEL_HUMAN)
  Core: HSSSHWLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDFSVPQLPXSSXHXLRXPR

SEQ ID NO: 335782 - protein, 25 aa, Artificial Sequence
  Description of Artificial Sequence: Synthetic peptide
  Seed: RLMKQDFSVPQLPHSSSHWLRLPRI (PMEL_HUMAN)
  Core: MKQDFSVPQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKQXFXVPXLPHSSSHWLRLPRI

SEQ ID NO: 335783 - protein, 25 aa, Artificial Sequence
  Description of Artificial Sequence: Synthetic peptide
  Seed: RLMKQDFSVPQLPHSSSHWLRLPRI (PMEL_HUMAN)
  Core: FSVPQLPHS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDXSVXQXPHXSSHWLRLPRI

SEQ ID NO: 335784 - protein, 25 aa, Artificial Sequence
  Description of Artificial Sequence: Synthetic peptide
  Seed: RLMKQDFSVPQLPHSSSHWLRLPRI (PMEL_HUMAN)
  Core: LPHSSSHWL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDFSVPQXPHXSXHWXRLPRI

SEQ ID NO: 335785 - protein, 25 aa, Artificial Sequence
  Description of Artificial Sequence: Synthetic peptide
  Seed: RLMKQDFSVPQLPHSSSHWLRLPRI (PMEL_HUMAN)
  Core: PHSSSHWLR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDFSVPQLXHSXSXWLXLPRI

SEQ ID NO: 335786 - protein, 25 aa, Artificial Sequence
  Description of Artificial Sequence: Synthetic peptide
  Seed: RLMKQDFSVPQLPHSSSHWLRLPRI (PMEL_HUMAN)
  Core: HSSSHWLRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLMKQDFSVPQLPXSSXHXLRXPRI

SEQ ID NO: 335787 - protein, 15 aa, Artificial Sequence
  Description of Artificial Sequence: Synthetic peptide
  Seed: RLPRIFCSCPIGENS (PMEL_HUMAN)
  Core: PRIFCSCPI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXRIXCXCPXGENS

SEQ ID NO: 335788 - protein, 15 aa, Artificial Sequence
  Description of Artificial Sequence: Synthetic peptide
  Seed: RLPRIFCSCPIGENS (PMEL_HUMAN)
  Core: RIFCSCPIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLPXIFXSXPIXENS

SEQ ID NO: 335789 - protein, 15 aa, Artificial Sequence
  Description of Artificial Sequence: Synthetic peptide
  Seed: RLPRIFCSCPIGENS (PMEL_HUMAN)
  Core: IFCSCPIGE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLPRXFCXCXIGXNS

SEQ ID NO: 335790 - protein, 15 aa, Artificial Sequence
  Description of Artificial Sequence: Synthetic peptide
  Seed: RLPRIFCSCPIGENS (PMEL_HUMAN)
  Core: FCSCPIGEN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLPRIXCSXPXGEXS

SEQ ID NO: 335791 - protein, 16 aa, Artificial Sequence
  Description of Artificial Sequence: Synthetic peptide
  Seed: RLPRIFCSCPIGENSP (PMEL_HUMAN)
  Core: IFCSCPIGE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLPRXFCXCXIGXNSP

SEQ ID NO: 335792 - protein, 17 aa, Artificial Sequence
  Description of Artificial Sequence: Synthetic peptide
  Seed: RLPRIFCSCPIGENSPL (PMEL_HUMAN)
  Core: IFCSCPIGE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLPRXFCXCXIGXNSPL

SEQ ID NO: 335793 - protein, 17 aa, Artificial Sequence
  Description of Artificial Sequence: Synthetic peptide
  Seed: RLPRIFCSCPIGENSPL (PMEL_HUMAN)
  Core: FCSCPIGEN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLPRIXCSXPXGEXSPL

SEQ ID NO: 335794 - protein, 19 aa, Artificial Sequence
  Description of Artificial Sequence: Synthetic peptide
  Seed: RLPRIFCSCPIGENSPLLS (PMEL_HUMAN)
  Core: PRIFCSCPI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXRIXCXCPXGENSPLLS

SEQ ID NO: 335795 - protein, 20 aa, Artificial Sequence
  Description of Artificial Sequence: Synthetic peptide
  Seed: RLPRIFCSCPIGENSPLLSG (PMEL_HUMAN)
  Core: PRIFCSCPI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXRIXCXCPXGENSPLLSG

SEQ ID NO: 335796 - protein, 20 aa, Artificial Sequence
  Description of Artificial Sequence: Synthetic peptide
  Seed: RLPRIFCSCPIGENSPLLSG (PMEL_HUMAN)
  Core: FCSCPIGEN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLPRIXCSXPXGEXSPLLSG

SEQ ID NO: 335797 - protein, 23 aa, Artificial Sequence
  Description of Artificial Sequence: Synthetic peptide
  Seed: RLPRIFCSCPIGENSPLLSGQQV (PMEL_HUMAN)
  Core: IGENSPLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RLPRIFCSCPXGEXSXLLXGQQV

SEQ ID NO: 335798 - protein, 14 aa, Artificial Sequence
  Description of Artificial Sequence: Synthetic peptide
  Seed: RLVKRQVPLDCVLY (PMEL_HUMAN)
  Core: VKRQVPLDC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKRXVXLDXVLY

SEQ ID NO: 335799 - protein, 14 aa, Artificial Sequence
  Description of Artificial Sequence: Synthetic peptide
  Seed: RLVKRQVPLDCVLY (PMEL_HUMAN)
  Core: KRQVPLDCV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLVXRQXPXDCXLY

SEQ ID NO: 335800 - protein, 15 aa, Artificial Sequence
  Description of Artificial Sequence: Synthetic peptide
  Seed: RLVKRQVPLDCVLYR (PMEL_HUMAN)
  Core: LVKRQVPLD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXVKXQXPLXCVLYR

SEQ ID NO: 335801 - protein, 15 aa, Artificial Sequence
  Description of Artificial Sequence: Synthetic peptide
  Seed: RLVKRQVPLDCVLYR (PMEL_HUMAN)
  Core: VKRQVPLDC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKRXVXLDXVLYR

SEQ ID NO: 335802 - protein, 15 aa, Artificial Sequence
  Description of Artificial Sequence: Synthetic peptide
  Seed: RLVKRQVPLDCVLYR (PMEL_HUMAN)
  Core: KRQVPLDCV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLVXRQXPXDCXLYR

SEQ ID NO: 335803 - protein, 15 aa, Artificial Sequence
  Description of Artificial Sequence: Synthetic peptide
  Seed: RLVKRQVPLDCVLYR (PMEL_HUMAN)
  Core: QVPLDCVLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRXVPXDXVLXR

SEQ ID NO: 335804 - protein, 15 aa, Artificial Sequence
  Description of Artificial Sequence: Synthetic peptide
  Seed: RLVKRQVPLDCVLYR (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYX

SEQ ID NO: 335805 - protein, 16 aa, Artificial Sequence
  Description of Artificial Sequence: Synthetic peptide
  Seed: RLVKRQVPLDCVLYRY (PMEL_HUMAN)
  Core: VKRQVPLDC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKRXVXLDXVLYRY

SEQ ID NO: 335806 - protein, 16 aa, Artificial Sequence
  Description of Artificial Sequence: Synthetic peptide
  Seed: RLVKRQVPLDCVLYRY (PMEL_HUMAN)
  Core: KRQVPLDCV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLVXRQXPXDCXLYRY

SEQ ID NO: 335807 - protein, 16 aa, Artificial Sequence
  Description of Artificial Sequence: Synthetic peptide
  Seed: RLVKRQVPLDCVLYRY (PMEL_HUMAN)
  Core: QVPLDCVLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRXVPXDXVLXRY

SEQ ID NO: 335808 - protein, 16 aa, Artificial Sequence
  Description of Artificial Sequence: Synthetic peptide
  Seed: RLVKRQVPLDCVLYRY (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYXY

SEQ ID NO: 335809 - protein, 17 aa, Artificial Sequence
  Description of Artificial Sequence: Synthetic peptide
  Seed: RLVKRQVPLDCVLYRYG (PMEL_HUMAN)
  Core: VKRQVPLDC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKRXVXLDXVLYRYG

SEQ ID NO: 335810 - protein, 17 aa, Artificial Sequence
  Description of Artificial Sequence: Synthetic peptide
  Seed: RLVKRQVPLDCVLYRYG (PMEL_HUMAN)
  Core: KRQVPLDCV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLVXRQXPXDCXLYRYG

SEQ ID NO: 335811 - protein, 17 aa, Artificial Sequence
  Description of Artificial Sequence: Synthetic peptide
  Seed: RLVKRQVPLDCVLYRYG (PMEL_HUMAN)
  Core: QVPLDCVLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRXVPXDXVLXRYG

SEQ ID NO: 335812 - protein, 17 aa, Artificial Sequence
  Description of Artificial Sequence: Synthetic peptide
  Seed: RLVKRQVPLDCVLYRYG (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYXYG

SEQ ID NO: 335813 - protein, 17 aa, Artificial Sequence
  Description of Artificial Sequence: Synthetic peptide
  Seed: RLVKRQVPLDCVLYRYG (PMEL_HUMAN)
  Core: LDCVLYRYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPXDCXLXRYX

SEQ ID NO: 335814 - protein, 18 aa, Artificial Sequence
  Description of Artificial Sequence: Synthetic peptide
  Seed: RLVKRQVPLDCVLYRYGS (PMEL_HUMAN)
  Core: QVPLDCVLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRXVPXDXVLXRYGS

SEQ ID NO: 335815 - protein, 19 aa, Artificial Sequence
  Description of Artificial Sequence: Synthetic peptide
  Seed: RLVKRQVPLDCVLYRYGSF (PMEL_HUMAN)
  Core: KRQVPLDCV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLVXRQXPXDCXLYRYGSF

SEQ ID NO: 335816 - protein, 19 aa, Artificial Sequence
  Description of Artificial Sequence: Synthetic peptide
  Seed: RLVKRQVPLDCVLYRYGSF (PMEL_HUMAN)
  Core: QVPLDCVLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRXVPXDXVLXRYGSF

SEQ ID NO: 335817 - protein, 19 aa, Artificial Sequence
  Description of Artificial Sequence: Synthetic peptide
  Seed: RLVKRQVPLDCVLYRYGSF (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYXYGSF

SEQ ID NO: 335818 - protein, 19 aa, Artificial Sequence
  Description of Artificial Sequence: Synthetic peptide
  Seed: RLVKRQVPLDCVLYRYGSF (PMEL_HUMAN)
  Core: LDCVLYRYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPXDCXLXRYXSF

SEQ ID NO: 335819 - protein, 20 aa, Artificial Sequence
  Description of Artificial Sequence: Synthetic peptide
  Seed: RLVKRQVPLDCVLYRYGSFS (PMEL_HUMAN)
  Core: VKRQVPLDC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKRXVXLDXVLYRYGSFS

SEQ ID NO: 335820 - protein, 20 aa, Artificial Sequence
  Description of Artificial Sequence: Synthetic peptide
  Seed: RLVKRQVPLDCVLYRYGSFS (PMEL_HUMAN)
  Core: KRQVPLDCV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLVXRQXPXDCXLYRYGSFS

SEQ ID NO: 335821 - protein, 20 aa, Artificial Sequence
  Description of Artificial Sequence: Synthetic peptide
  Seed: RLVKRQVPLDCVLYRYGSFS (PMEL_HUMAN)
  Core: QVPLDCVLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRXVPXDXVLXRYGSFS

SEQ ID NO: 335822 - protein, 20 aa, Artificial Sequence
  Description of Artificial Sequence: Synthetic peptide
  Seed: RLVKRQVPLDCVLYRYGSFS (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYXYGSFS

SEQ ID NO: 335823 - protein, 20 aa, Artificial Sequence
  Description of Artificial Sequence: Synthetic peptide
  Seed: RLVKRQVPLDCVLYRYGSFS (PMEL_HUMAN)
  Core: LDCVLYRYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPXDCXLXRYXSFS

SEQ ID NO: 335824 - protein, 21 aa, Artificial Sequence
  Description of Artificial Sequence: Synthetic peptide
  Seed: RLVKRQVPLDCVLYRYGSFSV (PMEL_HUMAN)
  Core: KRQVPLDCV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RLVXRQXPXDCXLYRYGSFSV

SEQ ID NO: 335825 - protein, 21 aa, Artificial Sequence
  Description of Artificial Sequence: Synthetic peptide
  Seed: RLVKRQVPLDCVLYRYGSFSV (PMEL_HUMAN)
  Core: QVPLDCVLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRXVPXDXVLXRYGSFSV

SEQ ID NO: 335826 - protein, 21 aa, Artificial Sequence
  Description of Artificial Sequence: Synthetic peptide
  Seed: RLVKRQVPLDCVLYRYGSFSV (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYXYGSFSV

SEQ ID NO: 335827 - protein, 21 aa, Artificial Sequence
  Description of Artificial Sequence: Synthetic peptide
  Seed: RLVKRQVPLDCVLYRYGSFSV (PMEL_HUMAN)
  Core: LDCVLYRYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPXDCXLXRYXSFSV

SEQ ID NO: 335828 - protein, 21 aa, Artificial Sequence
  Description of Artificial Sequence: Synthetic peptide
  Seed: RLVKRQVPLDCVLYRYGSFSV (PMEL_HUMAN)
  Core: LYRYGSFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVXYRXGXFSX

SEQ ID NO: 335829 - protein, 22 aa, Artificial Sequence
  Description of Artificial Sequence: Synthetic peptide
  Seed: RLVKRQVPLDCVLYRYGSFSVT (PMEL_HUMAN)
  Core: QVPLDCVLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRXVPXDXVLXRYGSFSVT

SEQ ID NO: 335830 - protein, 22 aa, Artificial Sequence
  Description of Artificial Sequence: Synthetic peptide
  Seed: RLVKRQVPLDCVLYRYGSFSVT (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYXYGSFSVT

SEQ ID NO: 335831 - protein, 22 aa, Artificial Sequence
  Description of Artificial Sequence: Synthetic peptide
  Seed: RLVKRQVPLDCVLYRYGSFSVT (PMEL_HUMAN)
  Core: LDCVLYRYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPXDCXLXRYXSFSVT

SEQ ID NO: 335832 - protein, 22 aa, Artificial Sequence
  Description of Artificial Sequence: Synthetic peptide
  Seed: RLVKRQVPLDCVLYRYGSFSVT (PMEL_HUMAN)
  Core: CVLYRYGSF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDXVLXRXGSXSVT

SEQ ID NO: 335833 - protein, 22 aa, Artificial Sequence
  Description of Artificial Sequence: Synthetic peptide
  Seed: RLVKRQVPLDCVLYRYGSFSVT (PMEL_HUMAN)
  Core: LYRYGSFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVXYRXGXFSXT

SEQ ID NO: 335834 - protein, 22 aa, Artificial Sequence
  Description of Artificial Sequence: Synthetic peptide
  Seed: RLVKRQVPLDCVLYRYGSFSVT (PMEL_HUMAN)
  Core: YRYGSFSVT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVLXRYXSXSVX

SEQ ID NO: 335835 - protein, 23 aa, Artificial Sequence
  Description of Artificial Sequence: Synthetic peptide
  Seed: RLVKRQVPLDCVLYRYGSFSVTL (PMEL_HUMAN)
  Core: VKRQVPLDC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKRXVXLDXVLYRYGSFSVTL

SEQ ID NO: 335836 - protein, 23 aa, Artificial Sequence
  Description of Artificial Sequence: Synthetic peptide
  Seed: RLVKRQVPLDCVLYRYGSFSVTL (PMEL_HUMAN)
  Core: RQVPLDCVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RLVKXQVXLXCVXYRYGSFSVTL

SEQ ID NO: 335837 - protein, 23 aa, Artificial Sequence
  Description of Artificial Sequence: Synthetic peptide
  Seed: RLVKRQVPLDCVLYRYGSFSVTL (PMEL_HUMAN)
  Core: QVPLDCVLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRXVPXDXVLXRYGSFSVTL

SEQ ID NO: 335838 - protein, 23 aa, Artificial Sequence
  Description of Artificial Sequence: Synthetic peptide
  Seed: RLVKRQVPLDCVLYRYGSFSVTL (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYXYGSFSVTL

SEQ ID NO: 335839 - protein, 23 aa, Artificial Sequence
  Description of Artificial Sequence: Synthetic peptide
  Seed: RLVKRQVPLDCVLYRYGSFSVTL (PMEL_HUMAN)
  Core: LDCVLYRYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPXDCXLXRYXSFSVTL

SEQ ID NO: 335840 - protein, 23 aa, Artificial Sequence
  Description of Artificial Sequence: Synthetic peptide
  Seed: RLVKRQVPLDCVLYRYGSFSVTL (PMEL_HUMAN)
  Core: CVLYRYGSF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDXVLXRXGSXSVTL

SEQ ID NO: 335841 - protein, 23 aa, Artificial Sequence
  Description of Artificial Sequence: Synthetic peptide
  Seed: RLVKRQVPLDCVLYRYGSFSVTL (PMEL_HUMAN)
  Core: LYRYGSFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVXYRXGXFSXTL

SEQ ID NO: 335842 - protein, 23 aa, Artificial Sequence
  Description of Artificial Sequence: Synthetic peptide
  Seed: RLVKRQVPLDCVLYRYGSFSVTL (PMEL_HUMAN)
  Core: YRYGSFSVT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVLXRYXSXSVXL

SEQ ID NO: 335843 - protein, 24 aa, Artificial Sequence
  Description of Artificial Sequence: Synthetic peptide
  Seed: RLVKRQVPLDCVLYRYGSFSVTLD (PMEL_HUMAN)
  Core: VKRQVPLDC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RLXKRXVXLDXVLYRYGSFSVTLD

SEQ ID NO: 335844 - protein, 24 aa, Artificial Sequence
  Description of Artificial Sequence: Synthetic peptide
  Seed: RLVKRQVPLDCVLYRYGSFSVTLD (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYXYGSFSVTLD

SEQ ID NO: 335845 - protein, 24 aa, Artificial Sequence
  Description of Artificial Sequence: Synthetic peptide
  Seed: RLVKRQVPLDCVLYRYGSFSVTLD (PMEL_HUMAN)
  Core: LDCVLYRYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPXDCXLXRYXSFSVTLD

SEQ ID NO: 335846 - protein, 24 aa, Artificial Sequence
  Description of Artificial Sequence: Synthetic peptide
  Seed: RLVKRQVPLDCVLYRYGSFSVTLD (PMEL_HUMAN)
  Core: LYRYGSFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVXYRXGXFSXTLD

SEQ ID NO: 335847 - protein, 24 aa, Artificial Sequence
  Description of Artificial Sequence: Synthetic peptide
  Seed: RLVKRQVPLDCVLYRYGSFSVTLD (PMEL_HUMAN)
  Core: YRYGSFSVT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVLXRYXSXSVXLD

SEQ ID NO: 335848 - protein, 24 aa, Artificial Sequence
  Description of Artificial Sequence: Synthetic peptide
  Seed: RLVKRQVPLDCVLYRYGSFSVTLD (PMEL_HUMAN)
  Core: RYGSFSVTL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVLYXYGXFXVTXD

SEQ ID NO: 335849 - protein, 24 aa, Artificial Sequence
  Description of Artificial Sequence: Synthetic peptide
  Seed: RLVKRQVPLDCVLYRYGSFSVTLD (PMEL_HUMAN)
  Core: YGSFSVTLD
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVLYRXGSXSXTLX

SEQ ID NO: 335850 - protein, 25 aa, Artificial Sequence
  Description of Artificial Sequence: Synthetic peptide
  Seed: RLVKRQVPLDCVLYRYGSFSVTLDI (PMEL_HUMAN)
  Core: VPLDCVLYR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQXPLXCXLYXYGSFSVTLDI

SEQ ID NO: 335851 - protein, 25 aa, Artificial Sequence
  Description of Artificial Sequence: Synthetic peptide
  Seed: RLVKRQVPLDCVLYRYGSFSVTLDI (PMEL_HUMAN)
  Core: LDCVLYRYG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPXDCXLXRYXSFSVTLDI

SEQ ID NO: 335852 - protein, 25 aa, Artificial Sequence
  Description of Artificial Sequence: Synthetic peptide
  Seed: RLVKRQVPLDCVLYRYGSFSVTLDI (PMEL_HUMAN)
  Core: LYRYGSFSV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVXYRXGXFSXTLDI

SEQ ID NO: 335853 - protein, 25 aa, Artificial Sequence
  Description of Artificial Sequence: Synthetic peptide
  Seed: RLVKRQVPLDCVLYRYGSFSVTLDI (PMEL_HUMAN)
  Core: YRYGSFSVT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVLXRYXSXSVXLDI

SEQ ID NO: 335854 - protein, 25 aa, Artificial Sequence
  Description of Artificial Sequence: Synthetic peptide
  Seed: RLVKRQVPLDCVLYRYGSFSVTLDI (PMEL_HUMAN)
  Core: RYGSFSVTL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVLYXYGXFXVTXDI

SEQ ID NO: 335855 - protein, 25 aa, Artificial Sequence
  Description of Artificial Sequence: Synthetic peptide
  Seed: RLVKRQVPLDCVLYRYGSFSVTLDI (PMEL_HUMAN)
  Core: YGSFSVTLD
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RLVKRQVPLDCVLYRXGSXSXTLXI

SEQ ID NO: 335856 - protein, 14 aa, Artificial Sequence
  Description of Artificial Sequence: Synthetic peptide
  Seed: RNQDWLGVSRQLRT (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXT

SEQ ID NO: 335857 - protein, 15 aa, Artificial Sequence
  Description of Artificial Sequence: Synthetic peptide
  Seed: RNQDWLGVSRQLRTK (PMEL_HUMAN)
  Core: DWLGVSRQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RNQXWLXVXRQXRTK

SEQ ID NO: 335858 - protein, 15 aa, Artificial Sequence
  Description of Artificial Sequence: Synthetic peptide
  Seed: RNQDWLGVSRQLRTK (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTK

SEQ ID NO: 335859 - protein, 16 aa, Artificial Sequence
  Description of Artificial Sequence: Synthetic peptide
  Seed: RNQDWLGVSRQLRTKA (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKA

SEQ ID NO: 335860 - protein, 16 aa, Artificial Sequence
  Description of Artificial Sequence: Synthetic peptide
  Seed: RNQDWLGVSRQLRTKA (PMEL_HUMAN)
  Core: LGVSRQLRT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWXGVXRXLRXKA

SEQ ID NO: 335861 - protein, 17 aa, Artificial Sequence
  Description of Artificial Sequence: Synthetic peptide
  Seed: RNQDWLGVSRQLRTKAW (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKAW

SEQ ID NO: 335862 - protein, 17 aa, Artificial Sequence
  Description of Artificial Sequence: Synthetic peptide
  Seed: RNQDWLGVSRQLRTKAW (PMEL_HUMAN)
  Core: LGVSRQLRT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWXGVXRXLRXKAW

SEQ ID NO: 335863 - protein, 18 aa, Artificial Sequence
  Description of Artificial Sequence: Synthetic peptide
  Seed: RNQDWLGVSRQLRTKAWN (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKAWN

SEQ ID NO: 335864 - protein, 19 aa, Artificial Sequence
  Description of Artificial Sequence: Synthetic peptide
  Seed: RNQDWLGVSRQLRTKAWNR (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKAWNR

SEQ ID NO: 335865 - protein, 19 aa, Artificial Sequence
  Description of Artificial Sequence: Synthetic peptide
  Seed: RNQDWLGVSRQLRTKAWNR (PMEL_HUMAN)
  Core: LGVSRQLRT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWXGVXRXLRXKAWNR

SEQ ID NO: 335866 - protein, 20 aa, Artificial Sequence
  Description of Artificial Sequence: Synthetic peptide
  Seed: RNQDWLGVSRQLRTKAWNRQ (PMEL_HUMAN)
  Core: DWLGVSRQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RNQXWLXVXRQXRTKAWNRQ

SEQ ID NO: 335867 - protein, 20 aa, Artificial Sequence
  Description of Artificial Sequence: Synthetic peptide
  Seed: RNQDWLGVSRQLRTKAWNRQ (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKAWNRQ

SEQ ID NO: 335868 - protein, 20 aa, Artificial Sequence
  Description of Artificial Sequence: Synthetic peptide
  Seed: RNQDWLGVSRQLRTKAWNRQ (PMEL_HUMAN)
  Core: LGVSRQLRT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWXGVXRXLRXKAWNRQ

SEQ ID NO: 335869 - protein, 20 aa, Artificial Sequence
  Description of Artificial Sequence: Synthetic peptide
  Seed: RNQDWLGVSRQLRTKAWNRQ (PMEL_HUMAN)
  Core: LRTKAWNRQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWLGVSRQXRTXAXNRX

SEQ ID NO: 335870 - protein, 21 aa, Artificial Sequence
  Description of Artificial Sequence: Synthetic peptide
  Seed: RNQDWLGVSRQLRTKAWNRQL (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKAWNRQL

SEQ ID NO: 335871 - protein, 21 aa, Artificial Sequence
  Description of Artificial Sequence: Synthetic peptide
  Seed: RNQDWLGVSRQLRTKAWNRQL (PMEL_HUMAN)
  Core: LRTKAWNRQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWLGVSRQXRTXAXNRXL

SEQ ID NO: 335872 - protein, 22 aa, Artificial Sequence
  Description of Artificial Sequence: Synthetic peptide
  Seed: RNQDWLGVSRQLRTKAWNRQLY (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKAWNRQLY

SEQ ID NO: 335873 - protein, 22 aa, Artificial Sequence
  Description of Artificial Sequence: Synthetic peptide
  Seed: RNQDWLGVSRQLRTKAWNRQLY (PMEL_HUMAN)
  Core: LRTKAWNRQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWLGVSRQXRTXAXNRXLY

SEQ ID NO: 335874 - protein, 23 aa, Artificial Sequence
  Description of Artificial Sequence: Synthetic peptide
  Seed: RNQDWLGVSRQLRTKAWNRQLYP (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKAWNRQLYP

SEQ ID NO: 335875 - protein, 23 aa, Artificial Sequence
  Description of Artificial Sequence: Synthetic peptide
  Seed: RNQDWLGVSRQLRTKAWNRQLYP (PMEL_HUMAN)
  Core: LRTKAWNRQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWLGVSRQXRTXAXNRXLYP

SEQ ID NO: 335876 - protein, 24 aa, Artificial Sequence
  Description of Artificial Sequence: Synthetic peptide
  Seed: RNQDWLGVSRQLRTKAWNRQLYPE (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKAWNRQLYPE

SEQ ID NO: 335877 - protein, 24 aa, Artificial Sequence
  Description of Artificial Sequence: Synthetic peptide
  Seed: RNQDWLGVSRQLRTKAWNRQLYPE (PMEL_HUMAN)
  Core: LRTKAWNRQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWLGVSRQXRTXAXNRXLYPE

SEQ ID NO: 335878 - protein, 24 aa, Artificial Sequence
  Description of Artificial Sequence: Synthetic peptide
  Seed: RNQDWLGVSRQLRTKAWNRQLYPE (PMEL_HUMAN)
  Core: TKAWNRQLY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWLGVSRQLRXKAXNXQLXPE

SEQ ID NO: 335879 - protein, 25 aa, Artificial Sequence
  Description of Artificial Sequence: Synthetic peptide
  Seed: RNQDWLGVSRQLRTKAWNRQLYPEW (PMEL_HUMAN)
  Core: WLGVSRQLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQDXLGXSXQLXTKAWNRQLYPEW

SEQ ID NO: 335880 - protein, 25 aa, Artificial Sequence
  Description of Artificial Sequence: Synthetic peptide
  Seed: RNQDWLGVSRQLRTKAWNRQLYPEW (PMEL_HUMAN)
  Core: LRTKAWNRQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWLGVSRQXRTXAXNRXLYPEW

SEQ ID NO: 335881 - protein, 25 aa, Artificial Sequence
  Description of Artificial Sequence: Synthetic peptide
  Seed: RNQDWLGVSRQLRTKAWNRQLYPEW (PMEL_HUMAN)
  Core: TKAWNRQLY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RNQDWLGVSRQLRXKAXNXQLXPEW

SEQ ID NO: 335882 - protein, 14 aa, Artificial Sequence
  Description of Artificial Sequence: Synthetic peptide
  Seed: RNQPLTFALQLHDP (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXP

SEQ ID NO: 335883 - protein, 15 aa, Artificial Sequence
  Description of Artificial Sequence: Synthetic peptide
  Seed: RNQPLTFALQLHDPS (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPS

SEQ ID NO: 335884 - protein, 16 aa, Artificial Sequence
  Description of Artificial Sequence: Synthetic peptide
  Seed: RNQPLTFALQLHDPSG (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSG

SEQ ID NO: 335885 - protein, 17 aa, Artificial Sequence
  Description of Artificial Sequence: Synthetic peptide
  Seed: RNQPLTFALQLHDPSGY (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSGY

SEQ ID NO: 335886 - protein, 17 aa, Artificial Sequence
  Description of Artificial Sequence: Synthetic peptide
  Seed: RNQPLTFALQLHDPSGY (PMEL_HUMAN)
  Core: FALQLHDPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTXALXLXDPXGY

SEQ ID NO: 335887 - protein, 18 aa, Artificial Sequence
  Description of Artificial Sequence: Synthetic peptide
  Seed: RNQPLTFALQLHDPSGYL (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSGYL

SEQ ID NO: 335888 - protein, 19 aa, Artificial Sequence
  Description of Artificial Sequence: Synthetic peptide
  Seed: RNQPLTFALQLHDPSGYLA (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSGYLA

SEQ ID NO: 335889 - protein, 19 aa, Artificial Sequence
  Description of Artificial Sequence: Synthetic peptide
  Seed: RNQPLTFALQLHDPSGYLA (PMEL_HUMAN)
  Core: FALQLHDPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTXALXLXDPXGYLA

SEQ ID NO: 335890 - protein, 19 aa, Artificial Sequence
  Description of Artificial Sequence: Synthetic peptide
  Seed: RNQPLTFALQLHDPSGYLA (PMEL_HUMAN)
  Core: LQLHDPSGY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFAXQLXDXSGXLA

SEQ ID NO: 335891 - protein, 20 aa, Artificial Sequence
  Description of Artificial Sequence: Synthetic peptide
  Seed: RNQPLTFALQLHDPSGYLAE (PMEL_HUMAN)
  Core: PLTFALQLH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RNQXLTXAXQLXDPSGYLAE

SEQ ID NO: 335892 - protein, 20 aa, Artificial Sequence
  Description of Artificial Sequence: Synthetic peptide
  Seed: RNQPLTFALQLHDPSGYLAE (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSGYLAE

SEQ ID NO: 335893 - protein, 20 aa, Artificial Sequence
  Description of Artificial Sequence: Synthetic peptide
  Seed: RNQPLTFALQLHDPSGYLAE (PMEL_HUMAN)
  Core: FALQLHDPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTXALXLXDPXGYLAE

SEQ ID NO: 335894 - protein, 20 aa, Artificial Sequence
  Description of Artificial Sequence: Synthetic peptide
  Seed: RNQPLTFALQLHDPSGYLAE (PMEL_HUMAN)
  Core: LQLHDPSGY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFAXQLXDXSGXLAE

SEQ ID NO: 335895 - protein, 21 aa, Artificial Sequence
  Description of Artificial Sequence: Synthetic peptide
  Seed: RNQPLTFALQLHDPSGYLAEA (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSGYLAEA

SEQ ID NO: 335896 - protein, 21 aa, Artificial Sequence
  Description of Artificial Sequence: Synthetic peptide
  Seed: RNQPLTFALQLHDPSGYLAEA (PMEL_HUMAN)
  Core: FALQLHDPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTXALXLXDPXGYLAEA

SEQ ID NO: 335897 - protein, 21 aa, Artificial Sequence
  Description of Artificial Sequence: Synthetic peptide
  Seed: RNQPLTFALQLHDPSGYLAEA (PMEL_HUMAN)
  Core: LQLHDPSGY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFAXQLXDXSGXLAEA

SEQ ID NO: 335898 - protein, 22 aa, Artificial Sequence
  Description of Artificial Sequence: Synthetic peptide
  Seed: RNQPLTFALQLHDPSGYLAEAD (PMEL_HUMAN)
  Core: PLTFALQLH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RNQXLTXAXQLXDPSGYLAEAD

SEQ ID NO: 335899 - protein, 22 aa, Artificial Sequence
  Description of Artificial Sequence: Synthetic peptide
  Seed: RNQPLTFALQLHDPSGYLAEAD (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSGYLAEAD

SEQ ID NO: 335900 - protein, 22 aa, Artificial Sequence
  Description of Artificial Sequence: Synthetic peptide
  Seed: RNQPLTFALQLHDPSGYLAEAD (PMEL_HUMAN)
  Core: FALQLHDPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTXALXLXDPXGYLAEAD

SEQ ID NO: 335901 - protein, 22 aa, Artificial Sequence
  Description of Artificial Sequence: Synthetic peptide
  Seed: RNQPLTFALQLHDPSGYLAEAD (PMEL_HUMAN)
  Core: LQLHDPSGY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFAXQLXDXSGXLAEAD

SEQ ID NO: 335902 - protein, 22 aa, Artificial Sequence
  Description of Artificial Sequence: Synthetic peptide
  Seed: RNQPLTFALQLHDPSGYLAEAD (PMEL_HUMAN)
  Core: LHDPSGYLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFALQXHDXSXYLXEAD

SEQ ID NO: 335903 - protein, 23 aa, Artificial Sequence
  Description of Artificial Sequence: Synthetic peptide
  Seed: RNQPLTFALQLHDPSGYLAEADL (PMEL_HUMAN)
  Core: PLTFALQLH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RNQXLTXAXQLXDPSGYLAEADL

SEQ ID NO: 335904 - protein, 23 aa, Artificial Sequence
  Description of Artificial Sequence: Synthetic peptide
  Seed: RNQPLTFALQLHDPSGYLAEADL (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSGYLAEADL

SEQ ID NO: 335905 - protein, 23 aa, Artificial Sequence
  Description of Artificial Sequence: Synthetic peptide
  Seed: RNQPLTFALQLHDPSGYLAEADL (PMEL_HUMAN)
  Core: FALQLHDPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTXALXLXDPXGYLAEADL

SEQ ID NO: 335906 - protein, 23 aa, Artificial Sequence
  Description of Artificial Sequence: Synthetic peptide
  Seed: RNQPLTFALQLHDPSGYLAEADL (PMEL_HUMAN)
  Core: LQLHDPSGY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFAXQLXDXSGXLAEADL

SEQ ID NO: 335907 - protein, 23 aa, Artificial Sequence
  Description of Artificial Sequence: Synthetic peptide
  Seed: RNQPLTFALQLHDPSGYLAEADL (PMEL_HUMAN)
  Core: LHDPSGYLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFALQXHDXSXYLXEADL

SEQ ID NO: 335908 - protein, 23 aa, Artificial Sequence
  Description of Artificial Sequence: Synthetic peptide
  Seed: RNQPLTFALQLHDPSGYLAEADL (PMEL_HUMAN)
  Core: PSGYLAEAD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFALQLHDXSGXLXEAXL

SEQ ID NO: 335909 - protein, 24 aa, Artificial Sequence
  Description of Artificial Sequence: Synthetic peptide
  Seed: RNQPLTFALQLHDPSGYLAEADLS (PMEL_HUMAN)
  Core: PLTFALQLH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RNQXLTXAXQLXDPSGYLAEADLS

SEQ ID NO: 335910 - protein, 24 aa, Artificial Sequence
  Description of Artificial Sequence: Synthetic peptide
  Seed: RNQPLTFALQLHDPSGYLAEADLS (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSGYLAEADLS

SEQ ID NO: 335911 - protein, 24 aa, Artificial Sequence
  Description of Artificial Sequence: Synthetic peptide
  Seed: RNQPLTFALQLHDPSGYLAEADLS (PMEL_HUMAN)
  Core: FALQLHDPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTXALXLXDPXGYLAEADLS

SEQ ID NO: 335912 - protein, 24 aa, Artificial Sequence
  Description of Artificial Sequence: Synthetic peptide
  Seed: RNQPLTFALQLHDPSGYLAEADLS (PMEL_HUMAN)
  Core: LQLHDPSGY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFAXQLXDXSGXLAEADLS

SEQ ID NO: 335913 - protein, 24 aa, Artificial Sequence
  Description of Artificial Sequence: Synthetic peptide
  Seed: RNQPLTFALQLHDPSGYLAEADLS (PMEL_HUMAN)
  Core: LHDPSGYLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFALQXHDXSXYLXEADLS

SEQ ID NO: 335914 - protein, 24 aa, Artificial Sequence
  Description of Artificial Sequence: Synthetic peptide
  Seed: RNQPLTFALQLHDPSGYLAEADLS (PMEL_HUMAN)
  Core: PSGYLAEAD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFALQLHDXSGXLXEAXLS

SEQ ID NO: 335915 - protein, 25 aa, Artificial Sequence
  Description of Artificial Sequence: Synthetic peptide
  Seed: RNQPLTFALQLHDPSGYLAEADLSY (PMEL_HUMAN)
  Core: LTFALQLHD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RNQPXTFXLXLHXPSGYLAEADLSY

SEQ ID NO: 335916 - protein, 25 aa, Artificial Sequence
  Description of Artificial Sequence: Synthetic peptide
  Seed: RNQPLTFALQLHDPSGYLAEADLSY (PMEL_HUMAN)
  Core: FALQLHDPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTXALXLXDPXGYLAEADLSY

SEQ ID NO: 335917 - protein, 25 aa, Artificial Sequence
  Description of Artificial Sequence: Synthetic peptide
  Seed: RNQPLTFALQLHDPSGYLAEADLSY (PMEL_HUMAN)
  Core: LQLHDPSGY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFAXQLXDXSGXLAEADLSY

SEQ ID NO: 335918 - protein, 25 aa, Artificial Sequence
  Description of Artificial Sequence: Synthetic peptide
  Seed: RNQPLTFALQLHDPSGYLAEADLSY (PMEL_HUMAN)
  Core: LHDPSGYLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFALQXHDXSXYLXEADLSY

SEQ ID NO: 335919 - protein, 25 aa, Artificial Sequence
  Description of Artificial Sequence: Synthetic peptide
  Seed: RNQPLTFALQLHDPSGYLAEADLSY (PMEL_HUMAN)
  Core: PSGYLAEAD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RNQPLTFALQLHDXSGXLXEAXLSY

SEQ ID NO: 335920 - protein, 17 aa, Artificial Sequence
  Description of Artificial Sequence: Synthetic peptide
  Seed: RPTAEAPNTTAGQVPTT (PMEL_HUMAN)
  Core: TTAGQVPTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RPTAEAPNXTAXQXPTX

SEQ ID NO: 335921 - protein, 18 aa, Artificial Sequence
  Description of Artificial Sequence: Synthetic peptide
  Seed: RPTAEAPNTTAGQVPTTE (PMEL_HUMAN)
  Core: TTAGQVPTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RPTAEAPNXTAXQXPTXE

SEQ ID NO: 335922 - protein, 19 aa, Artificial Sequence
  Description of Artificial Sequence: Synthetic peptide
  Seed: RPTAEAPNTTAGQVPTTEV (PMEL_HUMAN)
  Core: TTAGQVPTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RPTAEAPNXTAXQXPTXEV

SEQ ID NO: 335923 - protein, 20 aa, Artificial Sequence
  Description of Artificial Sequence: Synthetic peptide
  Seed: RPTAEAPNTTAGQVPTTEVV (PMEL_HUMAN)
  Core: TTAGQVPTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RPTAEAPNXTAXQXPTXEVV

SEQ ID NO: 335924 - protein, 21 aa, Artificial Sequence
  Description of Artificial Sequence: Synthetic peptide
  Seed: RPTAEAPNTTAGQVPTTEVVG (PMEL_HUMAN)
  Core: TTAGQVPTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RPTAEAPNXTAXQXPTXEVVG

SEQ ID NO: 335925 - protein, 22 aa, Artificial Sequence
  Description of Artificial Sequence: Synthetic peptide
  Seed: RPTAEAPNTTAGQVPTTEVVGT (PMEL_HUMAN)
  Core: TTAGQVPTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RPTAEAPNXTAXQXPTXEVVGT

SEQ ID NO: 335926 - protein, 23 aa, Artificial Sequence
  Description of Artificial Sequence: Synthetic peptide
  Seed: RPTAEAPNTTAGQVPTTEVVGTT (PMEL_HUMAN)
  Core: TTAGQVPTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RPTAEAPNXTAXQXPTXEVVGTT

SEQ ID NO: 335927 - protein, 24 aa, Artificial Sequence
  Description of Artificial Sequence: Synthetic peptide
  Seed: RPTAEAPNTTAGQVPTTEVVGTTP (PMEL_HUMAN)
  Core: TTAGQVPTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RPTAEAPNXTAXQXPTXEVVGTTP

SEQ ID NO: 335928 - protein, 25 aa, Artificial Sequence
  Description of Artificial Sequence: Synthetic peptide
  Seed: RPTAEAPNTTAGQVPTTEVVGTTPG (PMEL_HUMAN)
  Core: TTAGQVPTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RPTAEAPNXTAXQXPTXEVVGTTPG

SEQ ID NO: 335929 - protein, 14 aa, Artificial Sequence
  Description of Artificial Sequence: Synthetic peptide
  Seed: RQLRTKAWNRQLYP (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXP

SEQ ID NO: 335930 - protein, 15 aa, Artificial Sequence
  Description of Artificial Sequence: Synthetic peptide
  Seed: RQLRTKAWNRQLYPE (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPE

SEQ ID NO: 335931 - protein, 15 aa, Artificial Sequence
  Description of Artificial Sequence: Synthetic peptide
  Seed: RQLRTKAWNRQLYPE (PMEL_HUMAN)
  Core: RTKAWNRQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RQLXTKXWXRQXYPE

SEQ ID NO: 335932 - protein, 15 aa, Artificial Sequence
  Description of Artificial Sequence: Synthetic peptide
  Seed: RQLRTKAWNRQLYPE (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPE

SEQ ID NO: 335933 - protein, 16 aa, Artificial Sequence
  Description of Artificial Sequence: Synthetic peptide
  Seed: RQLRTKAWNRQLYPEW (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPEW

SEQ ID NO: 335934 - protein, 16 aa, Artificial Sequence
  Description of Artificial Sequence: Synthetic peptide
  Seed: RQLRTKAWNRQLYPEW (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEW

SEQ ID NO: 335935 - protein, 17 aa, Artificial Sequence
  Description of Artificial Sequence: Synthetic peptide
  Seed: RQLRTKAWNRQLYPEWT (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPEWT

SEQ ID NO: 335936 - protein, 17 aa, Artificial Sequence
  Description of Artificial Sequence: Synthetic peptide
  Seed: RQLRTKAWNRQLYPEWT (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEWT

SEQ ID NO: 335937 - protein, 18 aa, Artificial Sequence
  Description of Artificial Sequence: Synthetic peptide
  Seed: RQLRTKAWNRQLYPEWTE (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEWTE

SEQ ID NO: 335938 - protein, 19 aa, Artificial Sequence
  Description of Artificial Sequence: Synthetic peptide
  Seed: RQLRTKAWNRQLYPEWTEA (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPEWTEA

SEQ ID NO: 335939 - protein, 19 aa, Artificial Sequence
  Description of Artificial Sequence: Synthetic peptide
  Seed: RQLRTKAWNRQLYPEWTEA (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEWTEA

SEQ ID NO: 335940 - protein, 20 aa, Artificial Sequence
  Description of Artificial Sequence: Synthetic peptide
  Seed: RQLRTKAWNRQLYPEWTEAQ (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPEWTEAQ

SEQ ID NO: 335941 - protein, 20 aa, Artificial Sequence
  Description of Artificial Sequence: Synthetic peptide
  Seed: RQLRTKAWNRQLYPEWTEAQ (PMEL_HUMAN)
  Core: RTKAWNRQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RQLXTKXWXRQXYPEWTEAQ

SEQ ID NO: 335942 - protein, 20 aa, Artificial Sequence
  Description of Artificial Sequence: Synthetic peptide
  Seed: RQLRTKAWNRQLYPEWTEAQ (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEWTEAQ

SEQ ID NO: 335943 - protein, 20 aa, Artificial Sequence
  Description of Artificial Sequence: Synthetic peptide
  Seed: RQLRTKAWNRQLYPEWTEAQ (PMEL_HUMAN)
  Core: WNRQLYPEW
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAXNRXLXPEXTEAQ

SEQ ID NO: 335944 - protein, 20 aa, Artificial Sequence
  Description of Artificial Sequence: Synthetic peptide
  Seed: RQLRTKAWNRQLYPEWTEAQ (PMEL_HUMAN)
  Core: NRQLYPEWT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAWXRQXYXEWXEAQ

SEQ ID NO: 335945 - protein, 21 aa, Artificial Sequence
  Description of Artificial Sequence: Synthetic peptide
  Seed: RQLRTKAWNRQLYPEWTEAQR (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPEWTEAQR

SEQ ID NO: 335946 - protein, 21 aa, Artificial Sequence
  Description of Artificial Sequence: Synthetic peptide
  Seed: RQLRTKAWNRQLYPEWTEAQR (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEWTEAQR

SEQ ID NO: 335947 - protein, 21 aa, Artificial Sequence
  Description of Artificial Sequence: Synthetic peptide
  Seed: RQLRTKAWNRQLYPEWTEAQR (PMEL_HUMAN)
  Core: WNRQLYPEW
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAXNRXLXPEXTEAQR

SEQ ID NO: 335948 - protein, 21 aa, Artificial Sequence
  Description of Artificial Sequence: Synthetic peptide
  Seed: RQLRTKAWNRQLYPEWTEAQR (PMEL_HUMAN)
  Core: NRQLYPEWT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAWXRQXYXEWXEAQR

SEQ ID NO: 335949 - protein, 22 aa, Artificial Sequence
  Description of Artificial Sequence: Synthetic peptide
  Seed: RQLRTKAWNRQLYPEWTEAQRL (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPEWTEAQRL

SEQ ID NO: 335950 - protein, 22 aa, Artificial Sequence
  Description of Artificial Sequence: Synthetic peptide
  Seed: RQLRTKAWNRQLYPEWTEAQRL (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEWTEAQRL

SEQ ID NO: 335951 - protein, 22 aa, Artificial Sequence
  Description of Artificial Sequence: Synthetic peptide
  Seed: RQLRTKAWNRQLYPEWTEAQRL (PMEL_HUMAN)
  Core: WNRQLYPEW
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAXNRXLXPEXTEAQRL

SEQ ID NO: 335952 - protein, 22 aa, Artificial Sequence
  Description of Artificial Sequence: Synthetic peptide
  Seed: RQLRTKAWNRQLYPEWTEAQRL (PMEL_HUMAN)
  Core: NRQLYPEWT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAWXRQXYXEWXEAQRL

SEQ ID NO: 335953 - protein, 22 aa, Artificial Sequence
  Description of Artificial Sequence: Synthetic peptide
  Seed: RQLRTKAWNRQLYPEWTEAQRL (PMEL_HUMAN)
  Core: LYPEWTEAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAWNRQXYPXWXEAXRL

SEQ ID NO: 335954 - protein, 23 aa, Artificial Sequence
  Description of Artificial Sequence: Synthetic peptide
  Seed: RQLRTKAWNRQLYPEWTEAQRLD (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPEWTEAQRLD

SEQ ID NO: 335955 - protein, 23 aa, Artificial Sequence
  Description of Artificial Sequence: Synthetic peptide
  Seed: RQLRTKAWNRQLYPEWTEAQRLD (PMEL_HUMAN)
  Core: RTKAWNRQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RQLXTKXWXRQXYPEWTEAQRLD

SEQ ID NO: 335956 - protein, 23 aa, Artificial Sequence
  Description of Artificial Sequence: Synthetic peptide
  Seed: RQLRTKAWNRQLYPEWTEAQRLD (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEWTEAQRLD

SEQ ID NO: 335957 - protein, 23 aa, Artificial Sequence
  Description of Artificial Sequence: Synthetic peptide
  Seed: RQLRTKAWNRQLYPEWTEAQRLD (PMEL_HUMAN)
  Core: LYPEWTEAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAWNRQXYPXWXEAXRLD

SEQ ID NO: 335958 - protein, 24 aa, Artificial Sequence
  Description of Artificial Sequence: Synthetic peptide
  Seed: RQLRTKAWNRQLYPEWTEAQRLDC (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPEWTEAQRLDC

SEQ ID NO: 335959 - protein, 24 aa, Artificial Sequence
  Description of Artificial Sequence: Synthetic peptide
  Seed: RQLRTKAWNRQLYPEWTEAQRLDC (PMEL_HUMAN)
  Core: RTKAWNRQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RQLXTKXWXRQXYPEWTEAQRLDC

SEQ ID NO: 335960 - protein, 24 aa, Artificial Sequence
  Description of Artificial Sequence: Synthetic peptide
  Seed: RQLRTKAWNRQLYPEWTEAQRLDC (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEWTEAQRLDC

SEQ ID NO: 335961 - protein, 24 aa, Artificial Sequence
  Description of Artificial Sequence: Synthetic peptide
  Seed: RQLRTKAWNRQLYPEWTEAQRLDC (PMEL_HUMAN)
  Core: LYPEWTEAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAWNRQXYPXWXEAXRLDC

SEQ ID NO: 335962 - protein, 25 aa, Artificial Sequence
  Description of Artificial Sequence: Synthetic peptide
  Seed: RQLRTKAWNRQLYPEWTEAQRLDCW (PMEL_HUMAN)
  Core: LRTKAWNRQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXRTXAXNRXLYPEWTEAQRLDCW

SEQ ID NO: 335963 - protein, 25 aa, Artificial Sequence
  Description of Artificial Sequence: Synthetic peptide
  Seed: RQLRTKAWNRQLYPEWTEAQRLDCW (PMEL_HUMAN)
  Core: RTKAWNRQL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RQLXTKXWXRQXYPEWTEAQRLDCW

SEQ ID NO: 335964 - protein, 25 aa, Artificial Sequence
  Description of Artificial Sequence: Synthetic peptide
  Seed: RQLRTKAWNRQLYPEWTEAQRLDCW (PMEL_HUMAN)
  Core: TKAWNRQLY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQLRXKAXNXQLXPEWTEAQRLDCW

SEQ ID NO: 335965 - protein, 25 aa, Artificial Sequence
  Description of Artificial Sequence: Synthetic peptide
  Seed: RQLRTKAWNRQLYPEWTEAQRLDCW (PMEL_HUMAN)
  Core: LYPEWTEAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQLRTKAWNRQXYPXWXEAXRLDCW

SEQ ID NO: 335966 - protein, 25 aa, Artificial Sequence
  Description of Artificial Sequence: Synthetic peptide
  Seed: RQLYPEWTEAQRLDCWRGGQVSLKV (PMEL_HUMAN)
  Core: LDCWRGGQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RQLYPEWTEAQRXDCXRXGQXSLKV

SEQ ID NO: 335967 - protein, 15 aa, Artificial Sequence
  Description of Artificial Sequence: Synthetic peptide
  Seed: RQVPLDCVLYRYGSF (PMEL_HUMAN)
  Core: VPLDCVLYR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXPLXCXLYXYGSF

SEQ ID NO: 335968 - protein, 15 aa, Artificial Sequence
  Description of Artificial Sequence: Synthetic peptide
  Seed: RQVPLDCVLYRYGSF (PMEL_HUMAN)
  Core: LDCVLYRYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQVPXDCXLXRYXSF

SEQ ID NO: 335969 - protein, 16 aa, Artificial Sequence
  Description of Artificial Sequence: Synthetic peptide
  Seed: RQVPLDCVLYRYGSFS (PMEL_HUMAN)
  Core: LDCVLYRYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQVPXDCXLXRYXSFS

SEQ ID NO: 335970 - protein, 17 aa, Artificial Sequence
  Description of Artificial Sequence: Synthetic peptide
  Seed: RQVPLDCVLYRYGSFSV (PMEL_HUMAN)
  Core: VPLDCVLYR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RQXPLXCXLYXYGSFSV

SEQ ID NO: 335971 - protein, 17 aa, Artificial Sequence
  Description of Artificial Sequence: Synthetic peptide
  Seed: RQVPLDCVLYRYGSFSV (PMEL_HUMAN)
  Core: LDCVLYRYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQVPXDCXLXRYXSFSV

SEQ ID NO: 335972 - protein, 17 aa, Artificial Sequence
  Description of Artificial Sequence: Synthetic peptide
  Seed: RQVPLDCVLYRYGSFSV (PMEL_HUMAN)
  Core: LYRYGSFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVXYRXGXFSX

SEQ ID NO: 335973 - protein, 18 aa, Artificial Sequence
  Description of Artificial Sequence: Synthetic peptide
  Seed: RQVPLDCVLYRYGSFSVT (PMEL_HUMAN)
  Core: LDCVLYRYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQVPXDCXLXRYXSFSVT

SEQ ID NO: 335974 - protein, 18 aa, Artificial Sequence
  Description of Artificial Sequence: Synthetic peptide
  Seed: RQVPLDCVLYRYGSFSVT (PMEL_HUMAN)
  Core: LYRYGSFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVXYRXGXFSXT

SEQ ID NO: 335975 - protein, 18 aa, Artificial Sequence
  Description of Artificial Sequence: Synthetic peptide
  Seed: RQVPLDCVLYRYGSFSVT (PMEL_HUMAN)
  Core: YRYGSFSVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLXRYXSXSVX

SEQ ID NO: 335976 - protein, 19 aa, Artificial Sequence
  Description of Artificial Sequence: Synthetic peptide
  Seed: RQVPLDCVLYRYGSFSVTL (PMEL_HUMAN)
  Core: LDCVLYRYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQVPXDCXLXRYXSFSVTL

SEQ ID NO: 335977 - protein, 19 aa, Artificial Sequence
  Description of Artificial Sequence: Synthetic peptide
  Seed: RQVPLDCVLYRYGSFSVTL (PMEL_HUMAN)
  Core: CVLYRYGSF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDXVLXRXGSXSVTL

SEQ ID NO: 335978 - protein, 19 aa, Artificial Sequence
  Description of Artificial Sequence: Synthetic peptide
  Seed: RQVPLDCVLYRYGSFSVTL (PMEL_HUMAN)
  Core: LYRYGSFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVXYRXGXFSXTL

SEQ ID NO: 335979 - protein, 19 aa, Artificial Sequence
  Description of Artificial Sequence: Synthetic peptide
  Seed: RQVPLDCVLYRYGSFSVTL (PMEL_HUMAN)
  Core: YRYGSFSVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLXRYXSXSVXL

SEQ ID NO: 335980 - protein, 20 aa, Artificial Sequence
  Description of Artificial Sequence: Synthetic peptide
  Seed: RQVPLDCVLYRYGSFSVTLD (PMEL_HUMAN)
  Core: LDCVLYRYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQVPXDCXLXRYXSFSVTLD

SEQ ID NO: 335981 - protein, 20 aa, Artificial Sequence
  Description of Artificial Sequence: Synthetic peptide
  Seed: RQVPLDCVLYRYGSFSVTLD (PMEL_HUMAN)
  Core: CVLYRYGSF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDXVLXRXGSXSVTLD

SEQ ID NO: 335982 - protein, 20 aa, Artificial Sequence
  Description of Artificial Sequence: Synthetic peptide
  Seed: RQVPLDCVLYRYGSFSVTLD (PMEL_HUMAN)
  Core: LYRYGSFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVXYRXGXFSXTLD

SEQ ID NO: 335983 - protein, 20 aa, Artificial Sequence
  Description of Artificial Sequence: Synthetic peptide
  Seed: RQVPLDCVLYRYGSFSVTLD (PMEL_HUMAN)
  Core: YRYGSFSVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLXRYXSXSVXLD

SEQ ID NO: 335984 - protein, 20 aa, Artificial Sequence
  Description of Artificial Sequence: Synthetic peptide
  Seed: RQVPLDCVLYRYGSFSVTLD (PMEL_HUMAN)
  Core: RYGSFSVTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYXYGXFXVTXD

SEQ ID NO: 335985 - protein, 20 aa, Artificial Sequence
  Description of Artificial Sequence: Synthetic peptide
  Seed: RQVPLDCVLYRYGSFSVTLD (PMEL_HUMAN)
  Core: YGSFSVTLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYRXGSXSXTLX

SEQ ID NO: 335986 - protein, 21 aa, Artificial Sequence
  Description of Artificial Sequence: Synthetic peptide
  Seed: RQVPLDCVLYRYGSFSVTLDI (PMEL_HUMAN)
  Core: LDCVLYRYG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RQVPXDCXLXRYXSFSVTLDI

SEQ ID NO: 335987 - protein, 21 aa, Artificial Sequence
  Description of Artificial Sequence: Synthetic peptide
  Seed: RQVPLDCVLYRYGSFSVTLDI (PMEL_HUMAN)
  Core: LYRYGSFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVXYRXGXFSXTLDI

SEQ ID NO: 335988 - protein, 21 aa, Artificial Sequence
  Description of Artificial Sequence: Synthetic peptide
  Seed: RQVPLDCVLYRYGSFSVTLDI (PMEL_HUMAN)
  Core: YRYGSFSVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLXRYXSXSVXLDI

SEQ ID NO: 335989 - protein, 21 aa, Artificial Sequence
  Description of Artificial Sequence: Synthetic peptide
  Seed: RQVPLDCVLYRYGSFSVTLDI (PMEL_HUMAN)
  Core: RYGSFSVTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYXYGXFXVTXDI

SEQ ID NO: 335990 - protein, 21 aa, Artificial Sequence
  Description of Artificial Sequence: Synthetic peptide
  Seed: RQVPLDCVLYRYGSFSVTLDI (PMEL_HUMAN)
  Core: YGSFSVTLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYRXGSXSXTLXI

SEQ ID NO: 335991 - protein, 22 aa, Artificial Sequence
  Description of Artificial Sequence: Synthetic peptide
  Seed: RQVPLDCVLYRYGSFSVTLDIV (PMEL_HUMAN)
  Core: LYRYGSFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVXYRXGXFSXTLDIV

SEQ ID NO: 335992 - protein, 22 aa, Artificial Sequence
  Description of Artificial Sequence: Synthetic peptide
  Seed: RQVPLDCVLYRYGSFSVTLDIV (PMEL_HUMAN)
  Core: YRYGSFSVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLXRYXSXSVXLDIV

SEQ ID NO: 335993 - protein, 22 aa, Artificial Sequence
  Description of Artificial Sequence: Synthetic peptide
  Seed: RQVPLDCVLYRYGSFSVTLDIV (PMEL_HUMAN)
  Core: RYGSFSVTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYXYGXFXVTXDIV

SEQ ID NO: 335994 - protein, 22 aa, Artificial Sequence
  Description of Artificial Sequence: Synthetic peptide
  Seed: RQVPLDCVLYRYGSFSVTLDIV (PMEL_HUMAN)
  Core: YGSFSVTLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYRXGSXSXTLXIV

SEQ ID NO: 335995 - protein, 23 aa, Artificial Sequence
  Description of Artificial Sequence: Synthetic peptide
  Seed: RQVPLDCVLYRYGSFSVTLDIVQ (PMEL_HUMAN)
  Core: LYRYGSFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVXYRXGXFSXTLDIVQ

SEQ ID NO: 335996 - protein, 23 aa, Artificial Sequence
  Description of Artificial Sequence: Synthetic peptide
  Seed: RQVPLDCVLYRYGSFSVTLDIVQ (PMEL_HUMAN)
  Core: YRYGSFSVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLXRYXSXSVXLDIVQ

SEQ ID NO: 335997 - protein, 23 aa, Artificial Sequence
  Description of Artificial Sequence: Synthetic peptide
  Seed: RQVPLDCVLYRYGSFSVTLDIVQ (PMEL_HUMAN)
  Core: RYGSFSVTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYXYGXFXVTXDIVQ

SEQ ID NO: 335998 - protein, 23 aa, Artificial Sequence
  Description of Artificial Sequence: Synthetic peptide
  Seed: RQVPLDCVLYRYGSFSVTLDIVQ (PMEL_HUMAN)
  Core: YGSFSVTLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYRXGSXSXTLXIVQ

SEQ ID NO: 335999 - protein, 23 aa, Artificial Sequence
  Description of Artificial Sequence: Synthetic peptide
  Seed: RQVPLDCVLYRYGSFSVTLDIVQ (PMEL_HUMAN)
  Core: SFSVTLDIV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYRYGXFSXTXDIXQ

SEQ ID NO: 336000 - protein, 24 aa, Artificial Sequence
  Description of Artificial Sequence: Synthetic peptide
  Seed: RQVPLDCVLYRYGSFSVTLDIVQG (PMEL_HUMAN)
  Core: LYRYGSFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVXYRXGXFSXTLDIVQG

SEQ ID NO: 336001 - protein, 24 aa, Artificial Sequence
  Description of Artificial Sequence: Synthetic peptide
  Seed: RQVPLDCVLYRYGSFSVTLDIVQG (PMEL_HUMAN)
  Core: YRYGSFSVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLXRYXSXSVXLDIVQG

SEQ ID NO: 336002 - protein, 24 aa, Artificial Sequence
  Description of Artificial Sequence: Synthetic peptide
  Seed: RQVPLDCVLYRYGSFSVTLDIVQG (PMEL_HUMAN)
  Core: RYGSFSVTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYXYGXFXVTXDIVQG

SEQ ID NO: 336003 - protein, 24 aa, Artificial Sequence
  Description of Artificial Sequence: Synthetic peptide
  Seed: RQVPLDCVLYRYGSFSVTLDIVQG (PMEL_HUMAN)
  Core: YGSFSVTLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYRXGSXSXTLXIVQG

SEQ ID NO: 336004 - protein, 24 aa, Artificial Sequence
  Description of Artificial Sequence: Synthetic peptide
  Seed: RQVPLDCVLYRYGSFSVTLDIVQG (PMEL_HUMAN)
  Core: SFSVTLDIV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYRYGXFSXTXDIXQG

SEQ ID NO: 336005 - protein, 25 aa, Artificial Sequence
  Description of Artificial Sequence: Synthetic peptide
  Seed: RQVPLDCVLYRYGSFSVTLDIVQGI (PMEL_HUMAN)
  Core: LYRYGSFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVXYRXGXFSXTLDIVQGI

SEQ ID NO: 336006 - protein, 25 aa, Artificial Sequence
  Description of Artificial Sequence: Synthetic peptide
  Seed: RQVPLDCVLYRYGSFSVTLDIVQGI (PMEL_HUMAN)
  Core: YRYGSFSVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLXRYXSXSVXLDIVQGI

SEQ ID NO: 336007 - protein, 25 aa, Artificial Sequence
  Description of Artificial Sequence: Synthetic peptide
  Seed: RQVPLDCVLYRYGSFSVTLDIVQGI (PMEL_HUMAN)
  Core: RYGSFSVTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYXYGXFXVTXDIVQGI

SEQ ID NO: 336008 - protein, 25 aa, Artificial Sequence
  Description of Artificial Sequence: Synthetic peptide
  Seed: RQVPLDCVLYRYGSFSVTLDIVQGI (PMEL_HUMAN)
  Core: YGSFSVTLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYRXGSXSXTLXIVQGI

SEQ ID NO: 336009 - protein, 25 aa, Artificial Sequence
  Description of Artificial Sequence: Synthetic peptide
  Seed: RQVPLDCVLYRYGSFSVTLDIVQGI (PMEL_HUMAN)
  Core: SFSVTLDIV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RQVPLDCVLYRYGXFSXTXDIXQGI

SEQ ID NO: 336010 - protein, 13 aa, Artificial Sequence
  Description of Artificial Sequence: Synthetic peptide
  Seed: RRGSRSYVPLAHS (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHX

SEQ ID NO: 336011 - protein, 14 aa, Artificial Sequence
  Description of Artificial Sequence: Synthetic peptide
  Seed: RRGSRSYVPLAHSS (PMEL_HUMAN)
  Core: GSRSYVPLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RRXSRXYXPLXHSS

SEQ ID NO: 336012 - protein, 14 aa, Artificial Sequence
  Description of Artificial Sequence: Synthetic peptide
  Seed: RRGSRSYVPLAHSS (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSS

SEQ ID NO: 336013 - protein, 14 aa, Artificial Sequence
  Description of Artificial Sequence: Synthetic peptide
  Seed: RRGSRSYVPLAHSS (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXS

SEQ ID NO: 336014 - protein, 15 aa, Artificial Sequence
  Description of Artificial Sequence: Synthetic peptide
  Seed: RRGSRSYVPLAHSSS (PMEL_HUMAN)
  Core: GSRSYVPLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RRXSRXYXPLXHSSS

SEQ ID NO: 336015 - protein, 15 aa, Artificial Sequence
  Description of Artificial Sequence: Synthetic peptide
  Seed: RRGSRSYVPLAHSSS (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSS

SEQ ID NO: 336016 - protein, 15 aa, Artificial Sequence
  Description of Artificial Sequence: Synthetic peptide
  Seed: RRGSRSYVPLAHSSS (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSS

SEQ ID NO: 336017 - protein, 15 aa, Artificial Sequence
  Description of Artificial Sequence: Synthetic peptide
  Seed: RRGSRSYVPLAHSSS (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSX

SEQ ID NO: 336018 - protein, 16 aa, Artificial Sequence
  Description of Artificial Sequence: Synthetic peptide
  Seed: RRGSRSYVPLAHSSSA (PMEL_HUMAN)
  Core: GSRSYVPLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RRXSRXYXPLXHSSSA

SEQ ID NO: 336019 - protein, 16 aa, Artificial Sequence
  Description of Artificial Sequence: Synthetic peptide
  Seed: RRGSRSYVPLAHSSSA (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSA

SEQ ID NO: 336020 - protein, 16 aa, Artificial Sequence
  Description of Artificial Sequence: Synthetic peptide
  Seed: RRGSRSYVPLAHSSSA (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSA

SEQ ID NO: 336021 - protein, 16 aa, Artificial Sequence
  Description of Artificial Sequence: Synthetic peptide
  Seed: RRGSRSYVPLAHSSSA (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXA

SEQ ID NO: 336022 - protein, 17 aa, Artificial Sequence
  Description of Artificial Sequence: Synthetic peptide
  Seed: RRGSRSYVPLAHSSSAF (PMEL_HUMAN)
  Core: GSRSYVPLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RRXSRXYXPLXHSSSAF

SEQ ID NO: 336023 - protein, 17 aa, Artificial Sequence
  Description of Artificial Sequence: Synthetic peptide
  Seed: RRGSRSYVPLAHSSSAF (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSAF

SEQ ID NO: 336024 - protein, 17 aa, Artificial Sequence
  Description of Artificial Sequence: Synthetic peptide
  Seed: RRGSRSYVPLAHSSSAF (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSAF

SEQ ID NO: 336025 - protein, 17 aa, Artificial Sequence
  Description of Artificial Sequence: Synthetic peptide
  Seed: RRGSRSYVPLAHSSSAF (PMEL_HUMAN)
  Core: SYVPLAHSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRXYVXLXHSXSAF

SEQ ID NO: 336026 - protein, 17 aa, Artificial Sequence
  Description of Artificial Sequence: Synthetic peptide
  Seed: RRGSRSYVPLAHSSSAF (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXAF

SEQ ID NO: 336027 - protein, 18 aa, Artificial Sequence
  Description of Artificial Sequence: Synthetic peptide
  Seed: RRGSRSYVPLAHSSSAFT (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSAFT

SEQ ID NO: 336028 - protein, 18 aa, Artificial Sequence
  Description of Artificial Sequence: Synthetic peptide
  Seed: RRGSRSYVPLAHSSSAFT (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSAFT

SEQ ID NO: 336029 - protein, 18 aa, Artificial Sequence
  Description of Artificial Sequence: Synthetic peptide
  Seed: RRGSRSYVPLAHSSSAFT (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXAFT

SEQ ID NO: 336030 - protein, 18 aa, Artificial Sequence
  Description of Artificial Sequence: Synthetic peptide
  Seed: RRGSRSYVPLAHSSSAFT (PMEL_HUMAN)
  Core: LAHSSSAFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPXAHXSXAFX

SEQ ID NO: 336031 - protein, 19 aa, Artificial Sequence
  Description of Artificial Sequence: Synthetic peptide
  Seed: RRGSRSYVPLAHSSSAFTI (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSAFTI

SEQ ID NO: 336032 - protein, 19 aa, Artificial Sequence
  Description of Artificial Sequence: Synthetic peptide
  Seed: RRGSRSYVPLAHSSSAFTI (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSAFTI

SEQ ID NO: 336033 - protein, 19 aa, Artificial Sequence
  Description of Artificial Sequence: Synthetic peptide
  Seed: RRGSRSYVPLAHSSSAFTI (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXAFTI

SEQ ID NO: 336034 - protein, 19 aa, Artificial Sequence
  Description of Artificial Sequence: Synthetic peptide
  Seed: RRGSRSYVPLAHSSSAFTI (PMEL_HUMAN)
  Core: LAHSSSAFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPXAHXSXAFXI

SEQ ID NO: 336035 - protein, 20 aa, Artificial Sequence
  Description of Artificial Sequence: Synthetic peptide
  Seed: RRGSRSYVPLAHSSSAFTIT (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSAFTIT

SEQ ID NO: 336036 - protein, 20 aa, Artificial Sequence
  Description of Artificial Sequence: Synthetic peptide
  Seed: RRGSRSYVPLAHSSSAFTIT (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSAFTIT

SEQ ID NO: 336037 - protein, 20 aa, Artificial Sequence
  Description of Artificial Sequence: Synthetic peptide
  Seed: RRGSRSYVPLAHSSSAFTIT (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXAFTIT

SEQ ID NO: 336038 - protein, 20 aa, Artificial Sequence
  Description of Artificial Sequence: Synthetic peptide
  Seed: RRGSRSYVPLAHSSSAFTIT (PMEL_HUMAN)
  Core: LAHSSSAFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPXAHXSXAFXIT

SEQ ID NO: 336039 - protein, 20 aa, Artificial Sequence
  Description of Artificial Sequence: Synthetic peptide
  Seed: RRGSRSYVPLAHSSSAFTIT (PMEL_HUMAN)
  Core: AHSSSAFTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLXHSXSXFTXT

SEQ ID NO: 336040 - protein, 21 aa, Artificial Sequence
  Description of Artificial Sequence: Synthetic peptide
  Seed: RRGSRSYVPLAHSSSAFTITD (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSAFTITD

SEQ ID NO: 336041 - protein, 21 aa, Artificial Sequence
  Description of Artificial Sequence: Synthetic peptide
  Seed: RRGSRSYVPLAHSSSAFTITD (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSAFTITD

SEQ ID NO: 336042 - protein, 21 aa, Artificial Sequence
  Description of Artificial Sequence: Synthetic peptide
  Seed: RRGSRSYVPLAHSSSAFTITD (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXAFTITD

SEQ ID NO: 336043 - protein, 21 aa, Artificial Sequence
  Description of Artificial Sequence: Synthetic peptide
  Seed: RRGSRSYVPLAHSSSAFTITD (PMEL_HUMAN)
  Core: LAHSSSAFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPXAHXSXAFXITD

SEQ ID NO: 336044 - protein, 21 aa, Artificial Sequence
  Description of Artificial Sequence: Synthetic peptide
  Seed: RRGSRSYVPLAHSSSAFTITD (PMEL_HUMAN)
  Core: AHSSSAFTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLXHSXSXFTXTD

SEQ ID NO: 336045 - protein, 22 aa, Artificial Sequence
  Description of Artificial Sequence: Synthetic peptide
  Seed: RRGSRSYVPLAHSSSAFTITDQ (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSAFTITDQ

SEQ ID NO: 336046 - protein, 22 aa, Artificial Sequence
  Description of Artificial Sequence: Synthetic peptide
  Seed: RRGSRSYVPLAHSSSAFTITDQ (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSAFTITDQ

SEQ ID NO: 336047 - protein, 22 aa, Artificial Sequence
  Description of Artificial Sequence: Synthetic peptide
  Seed: RRGSRSYVPLAHSSSAFTITDQ (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXAFTITDQ

SEQ ID NO: 336048 - protein, 22 aa, Artificial Sequence
  Description of Artificial Sequence: Synthetic peptide
  Seed: RRGSRSYVPLAHSSSAFTITDQ (PMEL_HUMAN)
  Core: LAHSSSAFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPXAHXSXAFXITDQ

SEQ ID NO: 336049 - protein, 22 aa, Artificial Sequence
  Description of Artificial Sequence: Synthetic peptide
  Seed: RRGSRSYVPLAHSSSAFTITDQ (PMEL_HUMAN)
  Core: AHSSSAFTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLXHSXSXFTXTDQ

SEQ ID NO: 336050 - protein, 23 aa, Artificial Sequence
  Description of Artificial Sequence: Synthetic peptide
  Seed: RRGSRSYVPLAHSSSAFTITDQV (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSAFTITDQV

SEQ ID NO: 336051 - protein, 23 aa, Artificial Sequence
  Description of Artificial Sequence: Synthetic peptide
  Seed: RRGSRSYVPLAHSSSAFTITDQV (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSAFTITDQV

SEQ ID NO: 336052 - protein, 23 aa, Artificial Sequence
  Description of Artificial Sequence: Synthetic peptide
  Seed: RRGSRSYVPLAHSSSAFTITDQV (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXAFTITDQV

SEQ ID NO: 336053 - protein, 23 aa, Artificial Sequence
  Description of Artificial Sequence: Synthetic peptide
  Seed: RRGSRSYVPLAHSSSAFTITDQV (PMEL_HUMAN)
  Core: LAHSSSAFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPXAHXSXAFXITDQV

SEQ ID NO: 336054 - protein, 23 aa, Artificial Sequence
  Description of Artificial Sequence: Synthetic peptide
  Seed: RRGSRSYVPLAHSSSAFTITDQV (PMEL_HUMAN)
  Core: AHSSSAFTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLXHSXSXFTXTDQV

SEQ ID NO: 336055 - protein, 24 aa, Artificial Sequence
  Description of Artificial Sequence: Synthetic peptide
  Seed: RRGSRSYVPLAHSSSAFTITDQVP (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSAFTITDQVP

SEQ ID NO: 336056 - protein, 24 aa, Artificial Sequence
  Description of Artificial Sequence: Synthetic peptide
  Seed: RRGSRSYVPLAHSSSAFTITDQVP (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSAFTITDQVP

SEQ ID NO: 336057 - protein, 24 aa, Artificial Sequence
  Description of Artificial Sequence: Synthetic peptide
  Seed: RRGSRSYVPLAHSSSAFTITDQVP (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXAFTITDQVP

SEQ ID NO: 336058 - protein, 24 aa, Artificial Sequence
  Description of Artificial Sequence: Synthetic peptide
  Seed: RRGSRSYVPLAHSSSAFTITDQVP (PMEL_HUMAN)
  Core: LAHSSSAFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPXAHXSXAFXITDQVP

SEQ ID NO: 336059 - protein, 24 aa, Artificial Sequence
  Description of Artificial Sequence: Synthetic peptide
  Seed: RRGSRSYVPLAHSSSAFTITDQVP (PMEL_HUMAN)
  Core: AHSSSAFTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLXHSXSXFTXTDQVP

SEQ ID NO: 336060 - protein, 24 aa, Artificial Sequence
  Description of Artificial Sequence: Synthetic peptide
  Seed: RRGSRSYVPLAHSSSAFTITDQVP (PMEL_HUMAN)
  Core: SSSAFTITD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLAHXSSXFXITXQVP

SEQ ID NO: 336061 - protein, 25 aa, Artificial Sequence
  Description of Artificial Sequence: Synthetic peptide
  Seed: RRGSRSYVPLAHSSSAFTITDQVPF (PMEL_HUMAN)
  Core: SRSYVPLAH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRGXRSXVXLAXSSSAFTITDQVPF

SEQ ID NO: 336062 - protein, 25 aa, Artificial Sequence
  Description of Artificial Sequence: Synthetic peptide
  Seed: RRGSRSYVPLAHSSSAFTITDQVPF (PMEL_HUMAN)
  Core: RSYVPLAHS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRGSXSYXPXAHXSSAFTITDQVPF

SEQ ID NO: 336063 - protein, 25 aa, Artificial Sequence
  Description of Artificial Sequence: Synthetic peptide
  Seed: RRGSRSYVPLAHSSSAFTITDQVPF (PMEL_HUMAN)
  Core: YVPLAHSSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSXVPXAXSSXAFTITDQVPF

SEQ ID NO: 336064 - protein, 25 aa, Artificial Sequence
  Description of Artificial Sequence: Synthetic peptide
  Seed: RRGSRSYVPLAHSSSAFTITDQVPF (PMEL_HUMAN)
  Core: LAHSSSAFT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPXAHXSXAFXITDQVPF

SEQ ID NO: 336065 - protein, 25 aa, Artificial Sequence
  Description of Artificial Sequence: Synthetic peptide
  Seed: RRGSRSYVPLAHSSSAFTITDQVPF (PMEL_HUMAN)
  Core: AHSSSAFTI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLXHSXSXFTXTDQVPF

SEQ ID NO: 336066 - protein, 25 aa, Artificial Sequence
  Description of Artificial Sequence: Synthetic peptide
  Seed: RRGSRSYVPLAHSSSAFTITDQVPF (PMEL_HUMAN)
  Core: HSSSAFTIT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLAXSSXAXTIXDQVPF

SEQ ID NO: 336067 - protein, 25 aa, Artificial Sequence
  Description of Artificial Sequence: Synthetic peptide
  Seed: RRGSRSYVPLAHSSSAFTITDQVPF (PMEL_HUMAN)
  Core: SSSAFTITD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLAHXSSXFXITXQVPF

SEQ ID NO: 336068 - protein, 25 aa, Artificial Sequence
  Description of Artificial Sequence: Synthetic peptide
  Seed: RRGSRSYVPLAHSSSAFTITDQVPF (PMEL_HUMAN)
  Core: SSAFTITDQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RRGSRSYVPLAHSXSAXTXTDXVPF

SEQ ID NO: 336069 - protein, 13 aa, Artificial Sequence
  Description of Artificial Sequence: Synthetic peptide
  Seed: RRLMKQDFSVPQL (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXL

SEQ ID NO: 336070 - protein, 14 aa, Artificial Sequence
  Description of Artificial Sequence: Synthetic peptide
  Seed: RRLMKQDFSVPQLP (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLP

SEQ ID NO: 336071 - protein, 15 aa, Artificial Sequence
  Description of Artificial Sequence: Synthetic peptide
  Seed: RRLMKQDFSVPQLPH (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPH

SEQ ID NO: 336072 - protein, 16 aa, Artificial Sequence
  Description of Artificial Sequence: Synthetic peptide
  Seed: RRLMKQDFSVPQLPHS (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPHS

SEQ ID NO: 336073 - protein, 17 aa, Artificial Sequence
  Description of Artificial Sequence: Synthetic peptide
  Seed: RRLMKQDFSVPQLPHSS (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPHSS

SEQ ID NO: 336074 - protein, 17 aa, Artificial Sequence
  Description of Artificial Sequence: Synthetic peptide
  Seed: RRLMKQDFSVPQLPHSS (PMEL_HUMAN)
  Core: FSVPQLPHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDXSVXQXPHXS

SEQ ID NO: 336075 - protein, 19 aa, Artificial Sequence
  Description of Artificial Sequence: Synthetic peptide
  Seed: RRLMKQDFSVPQLPHSSSH (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPHSSSH

SEQ ID NO: 336076 - protein, 19 aa, Artificial Sequence
  Description of Artificial Sequence: Synthetic peptide
  Seed: RRLMKQDFSVPQLPHSSSH (PMEL_HUMAN)
  Core: FSVPQLPHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDXSVXQXPHXSSH

SEQ ID NO: 336077 - protein, 20 aa, Artificial Sequence
  Description of Artificial Sequence: Synthetic peptide
  Seed: RRLMKQDFSVPQLPHSSSHW (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPHSSSHW

SEQ ID NO: 336078 - protein, 20 aa, Artificial Sequence
  Description of Artificial Sequence: Synthetic peptide
  Seed: RRLMKQDFSVPQLPHSSSHW (PMEL_HUMAN)
  Core: KQDFSVPQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRLMXQDXSXPQXPHSSSHW

SEQ ID NO: 336079 - protein, 20 aa, Artificial Sequence
  Description of Artificial Sequence: Synthetic peptide
  Seed: RRLMKQDFSVPQLPHSSSHW (PMEL_HUMAN)
  Core: FSVPQLPHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDXSVXQXPHXSSHW

SEQ ID NO: 336080 - protein, 21 aa, Artificial Sequence
  Description of Artificial Sequence: Synthetic peptide
  Seed: RRLMKQDFSVPQLPHSSSHWL (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPHSSSHWL

SEQ ID NO: 336081 - protein, 21 aa, Artificial Sequence
  Description of Artificial Sequence: Synthetic peptide
  Seed: RRLMKQDFSVPQLPHSSSHWL (PMEL_HUMAN)
  Core: FSVPQLPHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDXSVXQXPHXSSHWL

SEQ ID NO: 336082 - protein, 22 aa, Artificial Sequence
  Description of Artificial Sequence: Synthetic peptide
  Seed: RRLMKQDFSVPQLPHSSSHWLR (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPHSSSHWLR

SEQ ID NO: 336083 - protein, 22 aa, Artificial Sequence
  Description of Artificial Sequence: Synthetic peptide
  Seed: RRLMKQDFSVPQLPHSSSHWLR (PMEL_HUMAN)
  Core: FSVPQLPHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDXSVXQXPHXSSHWLR

SEQ ID NO: 336084 - protein, 23 aa, Artificial Sequence
  Description of Artificial Sequence: Synthetic peptide
  Seed: RRLMKQDFSVPQLPHSSSHWLRL (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPHSSSHWLRL

SEQ ID NO: 336085 - protein, 23 aa, Artificial Sequence
  Description of Artificial Sequence: Synthetic peptide
  Seed: RRLMKQDFSVPQLPHSSSHWLRL (PMEL_HUMAN)
  Core: KQDFSVPQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRLMXQDXSXPQXPHSSSHWLRL

SEQ ID NO: 336086 - protein, 23 aa, Artificial Sequence
  Description of Artificial Sequence: Synthetic peptide
  Seed: RRLMKQDFSVPQLPHSSSHWLRL (PMEL_HUMAN)
  Core: FSVPQLPHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDXSVXQXPHXSSHWLRL

SEQ ID NO: 336087 - protein, 24 aa, Artificial Sequence
  Description of Artificial Sequence: Synthetic peptide
  Seed: RRLMKQDFSVPQLPHSSSHWLRLP (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPHSSSHWLRLP

SEQ ID NO: 336088 - protein, 24 aa, Artificial Sequence
  Description of Artificial Sequence: Synthetic peptide
  Seed: RRLMKQDFSVPQLPHSSSHWLRLP (PMEL_HUMAN)
  Core: KQDFSVPQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRLMXQDXSXPQXPHSSSHWLRLP

SEQ ID NO: 336089 - protein, 24 aa, Artificial Sequence
  Description of Artificial Sequence: Synthetic peptide
  Seed: RRLMKQDFSVPQLPHSSSHWLRLP (PMEL_HUMAN)
  Core: FSVPQLPHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDXSVXQXPHXSSHWLRLP

SEQ ID NO: 336090 - protein, 24 aa, Artificial Sequence
  Description of Artificial Sequence: Synthetic peptide
  Seed: RRLMKQDFSVPQLPHSSSHWLRLP (PMEL_HUMAN)
  Core: HSSSHWLRL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDFSVPQLPXSSXHXLRXP

SEQ ID NO: 336091 - protein, 25 aa, Artificial Sequence
  Description of Artificial Sequence: Synthetic peptide
  Seed: RRLMKQDFSVPQLPHSSSHWLRLPR (PMEL_HUMAN)
  Core: MKQDFSVPQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRLXKQXFXVPXLPHSSSHWLRLPR

SEQ ID NO: 336092 - protein, 25 aa, Artificial Sequence
  Description of Artificial Sequence: Synthetic peptide
  Seed: RRLMKQDFSVPQLPHSSSHWLRLPR (PMEL_HUMAN)
  Core: FSVPQLPHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDXSVXQXPHXSSHWLRLPR

SEQ ID NO: 336093 - protein, 25 aa, Artificial Sequence
  Description of Artificial Sequence: Synthetic peptide
  Seed: RRLMKQDFSVPQLPHSSSHWLRLPR (PMEL_HUMAN)
  Core: LPHSSSHWL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDFSVPQXPHXSXHWXRLPR

SEQ ID NO: 336094 - protein, 25 aa, Artificial Sequence
  Description of Artificial Sequence: Synthetic peptide
  Seed: RRLMKQDFSVPQLPHSSSHWLRLPR (PMEL_HUMAN)
  Core: HSSSHWLRL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RRLMKQDFSVPQLPXSSXHXLRXPR

SEQ ID NO: 336095 - protein, 14 aa, Artificial Sequence
  Description of Artificial Sequence: Synthetic peptide
  Seed: RRRLMKQDFSVPQL (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQL

SEQ ID NO: 336096 - protein, 14 aa, Artificial Sequence
  Description of Artificial Sequence: Synthetic peptide
  Seed: RRRLMKQDFSVPQL (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXL

SEQ ID NO: 336097 - protein, 15 aa, Artificial Sequence
  Description of Artificial Sequence: Synthetic peptide
  Seed: RRRLMKQDFSVPQLP (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQLP

SEQ ID NO: 336098 - protein, 15 aa, Artificial Sequence
  Description of Artificial Sequence: Synthetic peptide
  Seed: RRRLMKQDFSVPQLP (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLP

SEQ ID NO: 336099 - protein, 16 aa, Artificial Sequence
  Description of Artificial Sequence: Synthetic peptide
  Seed: RRRLMKQDFSVPQLPH (PMEL_HUMAN)
  Core: RLMKQDFSV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RRXLMXQXFSXPQLPH

SEQ ID NO: 336100 - protein, 16 aa, Artificial Sequence
  Description of Artificial Sequence: Synthetic peptide
  Seed: RRRLMKQDFSVPQLPH (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQLPH

SEQ ID NO: 336101 - protein, 16 aa, Artificial Sequence
  Description of Artificial Sequence: Synthetic peptide
  Seed: RRRLMKQDFSVPQLPH (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPH

SEQ ID NO: 336102 - protein, 17 aa, Artificial Sequence
  Description of Artificial Sequence: Synthetic peptide
  Seed: RRRLMKQDFSVPQLPHS (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQLPHS

SEQ ID NO: 336103 - protein, 17 aa, Artificial Sequence
  Description of Artificial Sequence: Synthetic peptide
  Seed: RRRLMKQDFSVPQLPHS (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPHS

SEQ ID NO: 336104 - protein, 17 aa, Artificial Sequence
  Description of Artificial Sequence: Synthetic peptide
  Seed: RRRLMKQDFSVPQLPHS (PMEL_HUMAN)
  Core: KQDFSVPQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RRRLMXQDXSXPQXPHS

SEQ ID NO: 336105 - protein, 18 aa, Artificial Sequence
  Description of Artificial Sequence: Synthetic peptide
  Seed: RRRLMKQDFSVPQLPHSS (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPHSS

SEQ ID NO: 336106 - protein, 19 aa, Artificial Sequence
  Description of Artificial Sequence: Synthetic peptide
  Seed: RRRLMKQDFSVPQLPHSSS (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQLPHSSS

SEQ ID NO: 336107 - protein, 19 aa, Artificial Sequence
  Description of Artificial Sequence: Synthetic peptide
  Seed: RRRLMKQDFSVPQLPHSSS (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPHSSS

SEQ ID NO: 336108 - protein, 19 aa, Artificial Sequence
  Description of Artificial Sequence: Synthetic peptide
  Seed: RRRLMKQDFSVPQLPHSSS (PMEL_HUMAN)
  Core: FSVPQLPHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRRLMKQDXSVXQXPHXSS

SEQ ID NO: 336109 - protein, 20 aa, Artificial Sequence
  Description of Artificial Sequence: Synthetic peptide
  Seed: RRRLMKQDFSVPQLPHSSSH (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQLPHSSSH

SEQ ID NO: 336110 - protein, 20 aa, Artificial Sequence
  Description of Artificial Sequence: Synthetic peptide
  Seed: RRRLMKQDFSVPQLPHSSSH (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPHSSSH

SEQ ID NO: 336111 - protein, 20 aa, Artificial Sequence
  Description of Artificial Sequence: Synthetic peptide
  Seed: RRRLMKQDFSVPQLPHSSSH (PMEL_HUMAN)
  Core: FSVPQLPHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRRLMKQDXSVXQXPHXSSH

SEQ ID NO: 336112 - protein, 21 aa, Artificial Sequence
  Description of Artificial Sequence: Synthetic peptide
  Seed: RRRLMKQDFSVPQLPHSSSHW (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPHSSSHW

SEQ ID NO: 336113 - protein, 21 aa, Artificial Sequence
  Description of Artificial Sequence: Synthetic peptide
  Seed: RRRLMKQDFSVPQLPHSSSHW (PMEL_HUMAN)
  Core: FSVPQLPHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRRLMKQDXSVXQXPHXSSHW

SEQ ID NO: 336114 - protein, 22 aa, Artificial Sequence
  Description of Artificial Sequence: Synthetic peptide
  Seed: RRRLMKQDFSVPQLPHSSSHWL (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQLPHSSSHWL

SEQ ID NO: 336115 - protein, 22 aa, Artificial Sequence
  Description of Artificial Sequence: Synthetic peptide
  Seed: RRRLMKQDFSVPQLPHSSSHWL (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPHSSSHWL

SEQ ID NO: 336116 - protein, 22 aa, Artificial Sequence
  Description of Artificial Sequence: Synthetic peptide
  Seed: RRRLMKQDFSVPQLPHSSSHWL (PMEL_HUMAN)
  Core: FSVPQLPHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRRLMKQDXSVXQXPHXSSHWL

SEQ ID NO: 336117 - protein, 23 aa, Artificial Sequence
  Description of Artificial Sequence: Synthetic peptide
  Seed: RRRLMKQDFSVPQLPHSSSHWLR (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQLPHSSSHWLR

SEQ ID NO: 336118 - protein, 23 aa, Artificial Sequence
  Description of Artificial Sequence: Synthetic peptide
  Seed: RRRLMKQDFSVPQLPHSSSHWLR (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPHSSSHWLR

SEQ ID NO: 336119 - protein, 23 aa, Artificial Sequence
  Description of Artificial Sequence: Synthetic peptide
  Seed: RRRLMKQDFSVPQLPHSSSHWLR (PMEL_HUMAN)
  Core: FSVPQLPHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRRLMKQDXSVXQXPHXSSHWLR

SEQ ID NO: 336120 - protein, 24 aa, Artificial Sequence
  Description of Artificial Sequence: Synthetic peptide
  Seed: RRRLMKQDFSVPQLPHSSSHWLRL (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQLPHSSSHWLRL

SEQ ID NO: 336121 - protein, 24 aa, Artificial Sequence
  Description of Artificial Sequence: Synthetic peptide
  Seed: RRRLMKQDFSVPQLPHSSSHWLRL (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPHSSSHWLRL

SEQ ID NO: 336122 - protein, 24 aa, Artificial Sequence
  Description of Artificial Sequence: Synthetic peptide
  Seed: RRRLMKQDFSVPQLPHSSSHWLRL (PMEL_HUMAN)
  Core: FSVPQLPHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRRLMKQDXSVXQXPHXSSHWLRL

SEQ ID NO: 336123 - protein, 25 aa, Artificial Sequence
  Description of Artificial Sequence: Synthetic peptide
  Seed: RRRLMKQDFSVPQLPHSSSHWLRLP (PMEL_HUMAN)
  Core: LMKQDFSVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RRRXMKXDXSVXQLPHSSSHWLRLP

SEQ ID NO: 336124 - protein, 25 aa, Artificial Sequence
  Description of Artificial Sequence: Synthetic peptide
  Seed: RRRLMKQDFSVPQLPHSSSHWLRLP (PMEL_HUMAN)
  Core: MKQDFSVPQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RRRLXKQXFXVPXLPHSSSHWLRLP

SEQ ID NO: 336125 - protein, 25 aa, Artificial Sequence
  Description of Artificial Sequence: Synthetic peptide
  Seed: RRRLMKQDFSVPQLPHSSSHWLRLP (PMEL_HUMAN)
  Core: FSVPQLPHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RRRLMKQDXSVXQXPHXSSHWLRLP

SEQ ID NO: 336126 - protein, 25 aa, Artificial Sequence
  Description of Artificial Sequence: Synthetic peptide
  Seed: RRRLMKQDFSVPQLPHSSSHWLRLP (PMEL_HUMAN)
  Core: HSSSHWLRL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RRRLMKQDFSVPQLPXSSXHXLRXP

SEQ ID NO: 336127 - protein, 13 aa, Artificial Sequence
  Description of Artificial Sequence: Synthetic peptide
  Seed: RSFVYVWKTWGQY (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQY

SEQ ID NO: 336128 - protein, 14 aa, Artificial Sequence
  Description of Artificial Sequence: Synthetic peptide
  Seed: RSFVYVWKTWGQYW (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYW

SEQ ID NO: 336129 - protein, 14 aa, Artificial Sequence
  Description of Artificial Sequence: Synthetic peptide
  Seed: RSFVYVWKTWGQYW (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYW

SEQ ID NO: 336130 - protein, 14 aa, Artificial Sequence
  Description of Artificial Sequence: Synthetic peptide
  Seed: RSFVYVWKTWGQYW (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXW

SEQ ID NO: 336131 - protein, 15 aa, Artificial Sequence
  Description of Artificial Sequence: Synthetic peptide
  Seed: RSFVYVWKTWGQYWQ (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQ

SEQ ID NO: 336132 - protein, 15 aa, Artificial Sequence
  Description of Artificial Sequence: Synthetic peptide
  Seed: RSFVYVWKTWGQYWQ (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQ

SEQ ID NO: 336133 - protein, 15 aa, Artificial Sequence
  Description of Artificial Sequence: Synthetic peptide
  Seed: RSFVYVWKTWGQYWQ (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQ

SEQ ID NO: 336134 - protein, 16 aa, Artificial Sequence
  Description of Artificial Sequence: Synthetic peptide
  Seed: RSFVYVWKTWGQYWQV (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQV

SEQ ID NO: 336135 - protein, 16 aa, Artificial Sequence
  Description of Artificial Sequence: Synthetic peptide
  Seed: RSFVYVWKTWGQYWQV (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQV

SEQ ID NO: 336136 - protein, 16 aa, Artificial Sequence
  Description of Artificial Sequence: Synthetic peptide
  Seed: RSFVYVWKTWGQYWQV (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQV

SEQ ID NO: 336137 - protein, 17 aa, Artificial Sequence
  Description of Artificial Sequence: Synthetic peptide
  Seed: RSFVYVWKTWGQYWQVL (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQVL

SEQ ID NO: 336138 - protein, 17 aa, Artificial Sequence
  Description of Artificial Sequence: Synthetic peptide
  Seed: RSFVYVWKTWGQYWQVL (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQVL

SEQ ID NO: 336139 - protein, 17 aa, Artificial Sequence
  Description of Artificial Sequence: Synthetic peptide
  Seed: RSFVYVWKTWGQYWQVL (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQVL

SEQ ID NO: 336140 - protein, 18 aa, Artificial Sequence
  Description of Artificial Sequence: Synthetic peptide
  Seed: RSFVYVWKTWGQYWQVLG (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQVLG

SEQ ID NO: 336141 - protein, 18 aa, Artificial Sequence
  Description of Artificial Sequence: Synthetic peptide
  Seed: RSFVYVWKTWGQYWQVLG (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQVLG

SEQ ID NO: 336142 - protein, 18 aa, Artificial Sequence
  Description of Artificial Sequence: Synthetic peptide
  Seed: RSFVYVWKTWGQYWQVLG (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQVLG

SEQ ID NO: 336143 - protein, 19 aa, Artificial Sequence
  Description of Artificial Sequence: Synthetic peptide
  Seed: RSFVYVWKTWGQYWQVLGG (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQVLGG

SEQ ID NO: 336144 - protein, 19 aa, Artificial Sequence
  Description of Artificial Sequence: Synthetic peptide
  Seed: RSFVYVWKTWGQYWQVLGG (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQVLGG

SEQ ID NO: 336145 - protein, 19 aa, Artificial Sequence
  Description of Artificial Sequence: Synthetic peptide
  Seed: RSFVYVWKTWGQYWQVLGG (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQVLGG

SEQ ID NO: 336146 - protein, 20 aa, Artificial Sequence
  Description of Artificial Sequence: Synthetic peptide
  Seed: RSFVYVWKTWGQYWQVLGGP (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQVLGGP

SEQ ID NO: 336147 - protein, 20 aa, Artificial Sequence
  Description of Artificial Sequence: Synthetic peptide
  Seed: RSFVYVWKTWGQYWQVLGGP (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQVLGGP

SEQ ID NO: 336148 - protein, 20 aa, Artificial Sequence
  Description of Artificial Sequence: Synthetic peptide
  Seed: RSFVYVWKTWGQYWQVLGGP (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQVLGGP

SEQ ID NO: 336149 - protein, 20 aa, Artificial Sequence
  Description of Artificial Sequence: Synthetic peptide
  Seed: RSFVYVWKTWGQYWQVLGGP (PMEL_HUMAN)
  Core: TWGQYWQVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKXWGXYXQVXGGP

SEQ ID NO: 336150 - protein, 21 aa, Artificial Sequence
  Description of Artificial Sequence: Synthetic peptide
  Seed: RSFVYVWKTWGQYWQVLGGPV (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQVLGGPV

SEQ ID NO: 336151 - protein, 21 aa, Artificial Sequence
  Description of Artificial Sequence: Synthetic peptide
  Seed: RSFVYVWKTWGQYWQVLGGPV (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQVLGGPV

SEQ ID NO: 336152 - protein, 21 aa, Artificial Sequence
  Description of Artificial Sequence: Synthetic peptide
  Seed: RSFVYVWKTWGQYWQVLGGPV (PMEL_HUMAN)
  Core: TWGQYWQVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKXWGXYXQVXGGPV

SEQ ID NO: 336153 - protein, 21 aa, Artificial Sequence
  Description of Artificial Sequence: Synthetic peptide
  Seed: RSFVYVWKTWGQYWQVLGGPV (PMEL_HUMAN)
  Core: GQYWQVLGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWXQYXQXLGXPV

SEQ ID NO: 336154 - protein, 21 aa, Artificial Sequence
  Description of Artificial Sequence: Synthetic peptide
  Seed: RSFVYVWKTWGQYWQVLGGPV (PMEL_HUMAN)
  Core: YWQVLGGPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWGQXWQXLXGPX

SEQ ID NO: 336155 - protein, 22 aa, Artificial Sequence
  Description of Artificial Sequence: Synthetic peptide
  Seed: RSFVYVWKTWGQYWQVLGGPVS (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQVLGGPVS

SEQ ID NO: 336156 - protein, 22 aa, Artificial Sequence
  Description of Artificial Sequence: Synthetic peptide
  Seed: RSFVYVWKTWGQYWQVLGGPVS (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQVLGGPVS

SEQ ID NO: 336157 - protein, 22 aa, Artificial Sequence
  Description of Artificial Sequence: Synthetic peptide
  Seed: RSFVYVWKTWGQYWQVLGGPVS (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQVLGGPVS

SEQ ID NO: 336158 - protein, 22 aa, Artificial Sequence
  Description of Artificial Sequence: Synthetic peptide
  Seed: RSFVYVWKTWGQYWQVLGGPVS (PMEL_HUMAN)
  Core: TWGQYWQVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKXWGXYXQVXGGPVS

SEQ ID NO: 336159 - protein, 22 aa, Artificial Sequence
  Description of Artificial Sequence: Synthetic peptide
  Seed: RSFVYVWKTWGQYWQVLGGPVS (PMEL_HUMAN)
  Core: GQYWQVLGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWXQYXQXLGXPVS

SEQ ID NO: 336160 - protein, 22 aa, Artificial Sequence
  Description of Artificial Sequence: Synthetic peptide
  Seed: RSFVYVWKTWGQYWQVLGGPVS (PMEL_HUMAN)
  Core: YWQVLGGPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWGQXWQXLXGPXS

SEQ ID NO: 336161 - protein, 23 aa, Artificial Sequence
  Description of Artificial Sequence: Synthetic peptide
  Seed: RSFVYVWKTWGQYWQVLGGPVSG (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQVLGGPVSG

SEQ ID NO: 336162 - protein, 23 aa, Artificial Sequence
  Description of Artificial Sequence: Synthetic peptide
  Seed: RSFVYVWKTWGQYWQVLGGPVSG (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQVLGGPVSG

SEQ ID NO: 336163 - protein, 23 aa, Artificial Sequence
  Description of Artificial Sequence: Synthetic peptide
  Seed: RSFVYVWKTWGQYWQVLGGPVSG (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQVLGGPVSG

SEQ ID NO: 336164 - protein, 23 aa, Artificial Sequence
  Description of Artificial Sequence: Synthetic peptide
  Seed: RSFVYVWKTWGQYWQVLGGPVSG (PMEL_HUMAN)
  Core: GQYWQVLGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWXQYXQXLGXPVSG

SEQ ID NO: 336165 - protein, 23 aa, Artificial Sequence
  Description of Artificial Sequence: Synthetic peptide
  Seed: RSFVYVWKTWGQYWQVLGGPVSG (PMEL_HUMAN)
  Core: YWQVLGGPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWGQXWQXLXGPXSG

SEQ ID NO: 336166 - protein, 23 aa, Artificial Sequence
  Description of Artificial Sequence: Synthetic peptide
  Seed: RSFVYVWKTWGQYWQVLGGPVSG (PMEL_HUMAN)
  Core: WQVLGGPVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWGQYXQVXGXPVXG

SEQ ID NO: 336167 - protein, 24 aa, Artificial Sequence
  Description of Artificial Sequence: Synthetic peptide
  Seed: RSFVYVWKTWGQYWQVLGGPVSGL (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQVLGGPVSGL

SEQ ID NO: 336168 - protein, 24 aa, Artificial Sequence
  Description of Artificial Sequence: Synthetic peptide
  Seed: RSFVYVWKTWGQYWQVLGGPVSGL (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQVLGGPVSGL

SEQ ID NO: 336169 - protein, 24 aa, Artificial Sequence
  Description of Artificial Sequence: Synthetic peptide
  Seed: RSFVYVWKTWGQYWQVLGGPVSGL (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQVLGGPVSGL

SEQ ID NO: 336170 - protein, 24 aa, Artificial Sequence
  Description of Artificial Sequence: Synthetic peptide
  Seed: RSFVYVWKTWGQYWQVLGGPVSGL (PMEL_HUMAN)
  Core: GQYWQVLGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWXQYXQXLGXPVSGL

SEQ ID NO: 336171 - protein, 24 aa, Artificial Sequence
  Description of Artificial Sequence: Synthetic peptide
  Seed: RSFVYVWKTWGQYWQVLGGPVSGL (PMEL_HUMAN)
  Core: YWQVLGGPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWGQXWQXLXGPXSGL

SEQ ID NO: 336172 - protein, 24 aa, Artificial Sequence
  Description of Artificial Sequence: Synthetic peptide
  Seed: RSFVYVWKTWGQYWQVLGGPVSGL (PMEL_HUMAN)
  Core: WQVLGGPVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWGQYXQVXGXPVXGL

SEQ ID NO: 336173 - protein, 25 aa, Artificial Sequence
  Description of Artificial Sequence: Synthetic peptide
  Seed: RSFVYVWKTWGQYWQVLGGPVSGLS (PMEL_HUMAN)
  Core: FVYVWKTWG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVYXWXTWXQYWQVLGGPVSGLS

SEQ ID NO: 336174 - protein, 25 aa, Artificial Sequence
  Description of Artificial Sequence: Synthetic peptide
  Seed: RSFVYVWKTWGQYWQVLGGPVSGLS (PMEL_HUMAN)
  Core: VYVWKTWGQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RSFXYVXKXWGXYWQVLGGPVSGLS

SEQ ID NO: 336175 - protein, 25 aa, Artificial Sequence
  Description of Artificial Sequence: Synthetic peptide
  Seed: RSFVYVWKTWGQYWQVLGGPVSGLS (PMEL_HUMAN)
  Core: YVWKTWGQY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RSFVXVWXTXGQXWQVLGGPVSGLS

SEQ ID NO: 336176 - protein, 25 aa, Artificial Sequence
  Description of Artificial Sequence: Synthetic peptide
  Seed: RSFVYVWKTWGQYWQVLGGPVSGLS (PMEL_HUMAN)
  Core: GQYWQVLGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWXQYXQXLGXPVSGLS

SEQ ID NO: 336177 - protein, 25 aa, Artificial Sequence
  Description of Artificial Sequence: Synthetic peptide
  Seed: RSFVYVWKTWGQYWQVLGGPVSGLS (PMEL_HUMAN)
  Core: YWQVLGGPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWGQXWQXLXGPXSGLS

SEQ ID NO: 336178 - protein, 25 aa, Artificial Sequence
  Description of Artificial Sequence: Synthetic peptide
  Seed: RSFVYVWKTWGQYWQVLGGPVSGLS (PMEL_HUMAN)
  Core: WQVLGGPVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWGQYXQVXGXPVXGLS

SEQ ID NO: 336179 - protein, 25 aa, Artificial Sequence
  Description of Artificial Sequence: Synthetic peptide
  Seed: RSFVYVWKTWGQYWQVLGGPVSGLS (PMEL_HUMAN)
  Core: VLGGPVSGL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
RSFVYVWKTWGQYWQXLGXPXSGXS

SEQ ID NO: 336180 - protein, 13 aa, Artificial Sequence
  Description of Artificial Sequence: Synthetic peptide
  Seed: RSYVPLAHSSSAF (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAF

SEQ ID NO: 336181 - protein, 14 aa, Artificial Sequence
  Description of Artificial Sequence: Synthetic peptide
  Seed: RSYVPLAHSSSAFT (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFT

SEQ ID NO: 336182 - protein, 14 aa, Artificial Sequence
  Description of Artificial Sequence: Synthetic peptide
  Seed: RSYVPLAHSSSAFT (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFX

SEQ ID NO: 336183 - protein, 15 aa, Artificial Sequence
  Description of Artificial Sequence: Synthetic peptide
  Seed: RSYVPLAHSSSAFTI (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTI

SEQ ID NO: 336184 - protein, 15 aa, Artificial Sequence
  Description of Artificial Sequence: Synthetic peptide
  Seed: RSYVPLAHSSSAFTI (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXI

SEQ ID NO: 336185 - protein, 15 aa, Artificial Sequence
  Description of Artificial Sequence: Synthetic peptide
  Seed: RSYVPLAHSSSAFTI (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTX

SEQ ID NO: 336186 - protein, 16 aa, Artificial Sequence
  Description of Artificial Sequence: Synthetic peptide
  Seed: RSYVPLAHSSSAFTIT (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTIT

SEQ ID NO: 336187 - protein, 16 aa, Artificial Sequence
  Description of Artificial Sequence: Synthetic peptide
  Seed: RSYVPLAHSSSAFTIT (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXIT

SEQ ID NO: 336188 - protein, 16 aa, Artificial Sequence
  Description of Artificial Sequence: Synthetic peptide
  Seed: RSYVPLAHSSSAFTIT (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXT

SEQ ID NO: 336189 - protein, 17 aa, Artificial Sequence
  Description of Artificial Sequence: Synthetic peptide
  Seed: RSYVPLAHSSSAFTITD (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTITD

SEQ ID NO: 336190 - protein, 17 aa, Artificial Sequence
  Description of Artificial Sequence: Synthetic peptide
  Seed: RSYVPLAHSSSAFTITD (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXITD

SEQ ID NO: 336191 - protein, 17 aa, Artificial Sequence
  Description of Artificial Sequence: Synthetic peptide
  Seed: RSYVPLAHSSSAFTITD (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXTD

SEQ ID NO: 336192 - protein, 18 aa, Artificial Sequence
  Description of Artificial Sequence: Synthetic peptide
  Seed: RSYVPLAHSSSAFTITDQ (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTITDQ

SEQ ID NO: 336193 - protein, 18 aa, Artificial Sequence
  Description of Artificial Sequence: Synthetic peptide
  Seed: RSYVPLAHSSSAFTITDQ (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXITDQ

SEQ ID NO: 336194 - protein, 18 aa, Artificial Sequence
  Description of Artificial Sequence: Synthetic peptide
  Seed: RSYVPLAHSSSAFTITDQ (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXTDQ

SEQ ID NO: 336195 - protein, 19 aa, Artificial Sequence
  Description of Artificial Sequence: Synthetic peptide
  Seed: RSYVPLAHSSSAFTITDQV (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTITDQV

SEQ ID NO: 336196 - protein, 19 aa, Artificial Sequence
  Description of Artificial Sequence: Synthetic peptide
  Seed: RSYVPLAHSSSAFTITDQV (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXITDQV

SEQ ID NO: 336197 - protein, 19 aa, Artificial Sequence
  Description of Artificial Sequence: Synthetic peptide
  Seed: RSYVPLAHSSSAFTITDQV (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXTDQV

SEQ ID NO: 336198 - protein, 19 aa, Artificial Sequence
  Description of Artificial Sequence: Synthetic peptide
  Seed: RSYVPLAHSSSAFTITDQV (PMEL_HUMAN)
  Core: HSSSAFTIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAXSSXAXTIXDQV

SEQ ID NO: 336199 - protein, 20 aa, Artificial Sequence
  Description of Artificial Sequence: Synthetic peptide
  Seed: RSYVPLAHSSSAFTITDQVP (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTITDQVP

SEQ ID NO: 336200 - protein, 20 aa, Artificial Sequence
  Description of Artificial Sequence: Synthetic peptide
  Seed: RSYVPLAHSSSAFTITDQVP (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXITDQVP

SEQ ID NO: 336201 - protein, 20 aa, Artificial Sequence
  Description of Artificial Sequence: Synthetic peptide
  Seed: RSYVPLAHSSSAFTITDQVP (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXTDQVP

SEQ ID NO: 336202 - protein, 20 aa, Artificial Sequence
  Description of Artificial Sequence: Synthetic peptide
  Seed: RSYVPLAHSSSAFTITDQVP (PMEL_HUMAN)
  Core: HSSSAFTIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAXSSXAXTIXDQVP

SEQ ID NO: 336203 - protein, 20 aa, Artificial Sequence
  Description of Artificial Sequence: Synthetic peptide
  Seed: RSYVPLAHSSSAFTITDQVP (PMEL_HUMAN)
  Core: SSSAFTITD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHXSSXFXITXQVP

SEQ ID NO: 336204 - protein, 20 aa, Artificial Sequence
  Description of Artificial Sequence: Synthetic peptide
  Seed: RSYVPLAHSSSAFTITDQVP (PMEL_HUMAN)
  Core: SSAFTITDQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSXSAXTXTDXVP

SEQ ID NO: 336205 - protein, 21 aa, Artificial Sequence
  Description of Artificial Sequence: Synthetic peptide
  Seed: RSYVPLAHSSSAFTITDQVPF (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTITDQVPF

SEQ ID NO: 336206 - protein, 21 aa, Artificial Sequence
  Description of Artificial Sequence: Synthetic peptide
  Seed: RSYVPLAHSSSAFTITDQVPF (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXITDQVPF

SEQ ID NO: 336207 - protein, 21 aa, Artificial Sequence
  Description of Artificial Sequence: Synthetic peptide
  Seed: RSYVPLAHSSSAFTITDQVPF (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXTDQVPF

SEQ ID NO: 336208 - protein, 21 aa, Artificial Sequence
  Description of Artificial Sequence: Synthetic peptide
  Seed: RSYVPLAHSSSAFTITDQVPF (PMEL_HUMAN)
  Core: HSSSAFTIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAXSSXAXTIXDQVPF

SEQ ID NO: 336209 - protein, 21 aa, Artificial Sequence
  Description of Artificial Sequence: Synthetic peptide
  Seed: RSYVPLAHSSSAFTITDQVPF (PMEL_HUMAN)
  Core: SSAFTITDQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSXSAXTXTDXVPF

SEQ ID NO: 336210 - protein, 21 aa, Artificial Sequence
  Description of Artificial Sequence: Synthetic peptide
  Seed: RSYVPLAHSSSAFTITDQVPF (PMEL_HUMAN)
  Core: SAFTITDQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSSXAFXIXDQXPF

SEQ ID NO: 336211 - protein, 22 aa, Artificial Sequence
  Description of Artificial Sequence: Synthetic peptide
  Seed: RSYVPLAHSSSAFTITDQVPFS (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTITDQVPFS

SEQ ID NO: 336212 - protein, 22 aa, Artificial Sequence
  Description of Artificial Sequence: Synthetic peptide
  Seed: RSYVPLAHSSSAFTITDQVPFS (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXITDQVPFS

SEQ ID NO: 336213 - protein, 22 aa, Artificial Sequence
  Description of Artificial Sequence: Synthetic peptide
  Seed: RSYVPLAHSSSAFTITDQVPFS (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXTDQVPFS

SEQ ID NO: 336214 - protein, 22 aa, Artificial Sequence
  Description of Artificial Sequence: Synthetic peptide
  Seed: RSYVPLAHSSSAFTITDQVPFS (PMEL_HUMAN)
  Core: HSSSAFTIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAXSSXAXTIXDQVPFS

SEQ ID NO: 336215 - protein, 22 aa, Artificial Sequence
  Description of Artificial Sequence: Synthetic peptide
  Seed: RSYVPLAHSSSAFTITDQVPFS (PMEL_HUMAN)
  Core: SSAFTITDQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSXSAXTXTDXVPFS

SEQ ID NO: 336216 - protein, 22 aa, Artificial Sequence
  Description of Artificial Sequence: Synthetic peptide
  Seed: RSYVPLAHSSSAFTITDQVPFS (PMEL_HUMAN)
  Core: SAFTITDQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSSXAFXIXDQXPFS

SEQ ID NO: 336217 - protein, 22 aa, Artificial Sequence
  Description of Artificial Sequence: Synthetic peptide
  Seed: RSYVPLAHSSSAFTITDQVPFS (PMEL_HUMAN)
  Core: FTITDQVPF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSSSAXTIXDXVPXS

SEQ ID NO: 336218 - protein, 23 aa, Artificial Sequence
  Description of Artificial Sequence: Synthetic peptide
  Seed: RSYVPLAHSSSAFTITDQVPFSV (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTITDQVPFSV

SEQ ID NO: 336219 - protein, 23 aa, Artificial Sequence
  Description of Artificial Sequence: Synthetic peptide
  Seed: RSYVPLAHSSSAFTITDQVPFSV (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXITDQVPFSV

SEQ ID NO: 336220 - protein, 23 aa, Artificial Sequence
  Description of Artificial Sequence: Synthetic peptide
  Seed: RSYVPLAHSSSAFTITDQVPFSV (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXTDQVPFSV

SEQ ID NO: 336221 - protein, 23 aa, Artificial Sequence
  Description of Artificial Sequence: Synthetic peptide
  Seed: RSYVPLAHSSSAFTITDQVPFSV (PMEL_HUMAN)
  Core: HSSSAFTIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAXSSXAXTIXDQVPFSV

SEQ ID NO: 336222 - protein, 23 aa, Artificial Sequence
  Description of Artificial Sequence: Synthetic peptide
  Seed: RSYVPLAHSSSAFTITDQVPFSV (PMEL_HUMAN)
  Core: SSAFTITDQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSXSAXTXTDXVPFSV

SEQ ID NO: 336223 - protein, 23 aa, Artificial Sequence
  Description of Artificial Sequence: Synthetic peptide
  Seed: RSYVPLAHSSSAFTITDQVPFSV (PMEL_HUMAN)
  Core: SAFTITDQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSSXAFXIXDQXPFSV

SEQ ID NO: 336224 - protein, 23 aa, Artificial Sequence
  Description of Artificial Sequence: Synthetic peptide
  Seed: RSYVPLAHSSSAFTITDQVPFSV (PMEL_HUMAN)
  Core: FTITDQVPF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSSSAXTIXDXVPXSV

SEQ ID NO: 336225 - protein, 24 aa, Artificial Sequence
  Description of Artificial Sequence: Synthetic peptide
  Seed: RSYVPLAHSSSAFTITDQVPFSVS (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTITDQVPFSVS

SEQ ID NO: 336226 - protein, 24 aa, Artificial Sequence
  Description of Artificial Sequence: Synthetic peptide
  Seed: RSYVPLAHSSSAFTITDQVPFSVS (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXITDQVPFSVS

SEQ ID NO: 336227 - protein, 24 aa, Artificial Sequence
  Description of Artificial Sequence: Synthetic peptide
  Seed: RSYVPLAHSSSAFTITDQVPFSVS (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXTDQVPFSVS

SEQ ID NO: 336228 - protein, 24 aa, Artificial Sequence
  Description of Artificial Sequence: Synthetic peptide
  Seed: RSYVPLAHSSSAFTITDQVPFSVS (PMEL_HUMAN)
  Core: HSSSAFTIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAXSSXAXTIXDQVPFSVS

SEQ ID NO: 336229 - protein, 24 aa, Artificial Sequence
  Description of Artificial Sequence: Synthetic peptide
  Seed: RSYVPLAHSSSAFTITDQVPFSVS (PMEL_HUMAN)
  Core: SSAFTITDQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSXSAXTXTDXVPFSVS

SEQ ID NO: 336230 - protein, 24 aa, Artificial Sequence
  Description of Artificial Sequence: Synthetic peptide
  Seed: RSYVPLAHSSSAFTITDQVPFSVS (PMEL_HUMAN)
  Core: SAFTITDQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSSXAFXIXDQXPFSVS

SEQ ID NO: 336231 - protein, 24 aa, Artificial Sequence
  Description of Artificial Sequence: Synthetic peptide
  Seed: RSYVPLAHSSSAFTITDQVPFSVS (PMEL_HUMAN)
  Core: FTITDQVPF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSSSAXTIXDXVPXSVS

SEQ ID NO: 336232 - protein, 25 aa, Artificial Sequence
  Description of Artificial Sequence: Synthetic peptide
  Seed: RSYVPLAHSSSAFTITDQVPFSVSV (PMEL_HUMAN)
  Core: YVPLAHSSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
RSXVPXAXSSXAFTITDQVPFSVSV

SEQ ID NO: 336233 - protein, 25 aa, Artificial Sequence
  Description of Artificial Sequence: Synthetic peptide
  Seed: RSYVPLAHSSSAFTITDQVPFSVSV (PMEL_HUMAN)
  Core: LAHSSSAFT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPXAHXSXAFXITDQVPFSVSV

SEQ ID NO: 336234 - protein, 25 aa, Artificial Sequence
  Description of Artificial Sequence: Synthetic peptide
  Seed: RSYVPLAHSSSAFTITDQVPFSVSV (PMEL_HUMAN)
  Core: AHSSSAFTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLXHSXSXFTXTDQVPFSVSV

SEQ ID NO: 336235 - protein, 25 aa, Artificial Sequence
  Description of Artificial Sequence: Synthetic peptide
  Seed: RSYVPLAHSSSAFTITDQVPFSVSV (PMEL_HUMAN)
  Core: HSSSAFTIT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAXSSXAXTIXDQVPFSVSV

SEQ ID NO: 336236 - protein, 25 aa, Artificial Sequence
  Description of Artificial Sequence: Synthetic peptide
  Seed: RSYVPLAHSSSAFTITDQVPFSVSV (PMEL_HUMAN)
  Core: SSAFTITDQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSXSAXTXTDXVPFSVSV

SEQ ID NO: 336237 - protein, 25 aa, Artificial Sequence
  Description of Artificial Sequence: Synthetic peptide
  Seed: RSYVPLAHSSSAFTITDQVPFSVSV (PMEL_HUMAN)
  Core: SAFTITDQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSSXAFXIXDQXPFSVSV

SEQ ID NO: 336238 - protein, 25 aa, Artificial Sequence
  Description of Artificial Sequence: Synthetic peptide
  Seed: RSYVPLAHSSSAFTITDQVPFSVSV (PMEL_HUMAN)
  Core: FTITDQVPF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
RSYVPLAHSSSAXTIXDXVPXSVSV

SEQ ID NO: 336239 - protein, 15 aa, Artificial Sequence
  Description of Artificial Sequence: Synthetic peptide
  Seed: RTKAWNRQLYPEWTE (PMEL_HUMAN)
  Core: TKAWNRQLY
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXKAXNXQLXPEWTE

SEQ ID NO: 336240 - protein, 19 aa, Artificial Sequence
  Description of Artificial Sequence: Synthetic peptide
  Seed: RTKAWNRQLYPEWTEAQRL (PMEL_HUMAN)
  Core: NRQLYPEWT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
RTKAWXRQXYXEWXEAQRL

SEQ ID NO: 336241 - protein, 19 aa, Artificial Sequence
  Description of Artificial Sequence: Synthetic peptide
  Seed: RTKAWNRQLYPEWTEAQRL (PMEL_HUMAN)
  Core: LYPEWTEAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RTKAWNRQXYPXWXEAXRL

SEQ ID NO: 336242 - protein, 20 aa, Artificial Sequence
  Description of Artificial Sequence: Synthetic peptide
  Seed: RTKAWNRQLYPEWTEAQRLD (PMEL_HUMAN)
  Core: LYPEWTEAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RTKAWNRQXYPXWXEAXRLD

SEQ ID NO: 336243 - protein, 21 aa, Artificial Sequence
  Description of Artificial Sequence: Synthetic peptide
  Seed: RTKAWNRQLYPEWTEAQRLDC (PMEL_HUMAN)
  Core: LYPEWTEAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RTKAWNRQXYPXWXEAXRLDC

SEQ ID NO: 336244 - protein, 22 aa, Artificial Sequence
  Description of Artificial Sequence: Synthetic peptide
  Seed: RTKAWNRQLYPEWTEAQRLDCW (PMEL_HUMAN)
  Core: LYPEWTEAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RTKAWNRQXYPXWXEAXRLDCW

SEQ ID NO: 336245 - protein, 23 aa, Artificial Sequence
  Description of Artificial Sequence: Synthetic peptide
  Seed: RTKAWNRQLYPEWTEAQRLDCWR (PMEL_HUMAN)
  Core: LYPEWTEAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RTKAWNRQXYPXWXEAXRLDCWR

SEQ ID NO: 336246 - protein, 24 aa, Artificial Sequence
  Description of Artificial Sequence: Synthetic peptide
  Seed: RTKAWNRQLYPEWTEAQRLDCWRG (PMEL_HUMAN)
  Core: LYPEWTEAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RTKAWNRQXYPXWXEAXRLDCWRG

SEQ ID NO: 336247 - protein, 25 aa, Artificial Sequence
  Description of Artificial Sequence: Synthetic peptide
  Seed: RTKAWNRQLYPEWTEAQRLDCWRGG (PMEL_HUMAN)
  Core: LYPEWTEAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RTKAWNRQXYPXWXEAXRLDCWRGG

SEQ ID NO: 336248 - protein, 13 aa, Artificial Sequence
  Description of Artificial Sequence: Synthetic peptide
  Seed: RYGSFSVTLDIVQ (PMEL_HUMAN)
  Core: YGSFSVTLD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
RXGSXSXTLXIVQ

SEQ ID NO: 336249 - protein, 13 aa, Artificial Sequence
  Description of Artificial Sequence: Synthetic peptide
  Seed: RYGSFSVTLDIVQ (PMEL_HUMAN)
  Core: SFSVTLDIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RYGXFSXTXDIXQ

SEQ ID NO: 336250 - protein, 13 aa, Artificial Sequence
  Description of Artificial Sequence: Synthetic peptide
  Seed: RYGSFSVTLDIVQ (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVX

SEQ ID NO: 336251 - protein, 14 aa, Artificial Sequence
  Description of Artificial Sequence: Synthetic peptide
  Seed: RYGSFSVTLDIVQG (PMEL_HUMAN)
  Core: SFSVTLDIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RYGXFSXTXDIXQG

SEQ ID NO: 336252 - protein, 14 aa, Artificial Sequence
  Description of Artificial Sequence: Synthetic peptide
  Seed: RYGSFSVTLDIVQG (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXG

SEQ ID NO: 336253 - protein, 15 aa, Artificial Sequence
  Description of Artificial Sequence: Synthetic peptide
  Seed: RYGSFSVTLDIVQGI (PMEL_HUMAN)
  Core: SFSVTLDIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RYGXFSXTXDIXQGI

SEQ ID NO: 336254 - protein, 15 aa, Artificial Sequence
  Description of Artificial Sequence: Synthetic peptide
  Seed: RYGSFSVTLDIVQGI (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGI

SEQ ID NO: 336255 - protein, 15 aa, Artificial Sequence
  Description of Artificial Sequence: Synthetic peptide
  Seed: RYGSFSVTLDIVQGI (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGX

SEQ ID NO: 336256 - protein, 16 aa, Artificial Sequence
  Description of Artificial Sequence: Synthetic peptide
  Seed: RYGSFSVTLDIVQGIE (PMEL_HUMAN)
  Core: SFSVTLDIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RYGXFSXTXDIXQGIE

SEQ ID NO: 336257 - protein, 16 aa, Artificial Sequence
  Description of Artificial Sequence: Synthetic peptide
  Seed: RYGSFSVTLDIVQGIE (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIE

SEQ ID NO: 336258 - protein, 16 aa, Artificial Sequence
  Description of Artificial Sequence: Synthetic peptide
  Seed: RYGSFSVTLDIVQGIE (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXE

SEQ ID NO: 336259 - protein, 17 aa, Artificial Sequence
  Description of Artificial Sequence: Synthetic peptide
  Seed: RYGSFSVTLDIVQGIES (PMEL_HUMAN)
  Core: SFSVTLDIV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
RYGXFSXTXDIXQGIES

SEQ ID NO: 336260 - protein, 17 aa, Artificial Sequence
  Description of Artificial Sequence: Synthetic peptide
  Seed: RYGSFSVTLDIVQGIES (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIES

SEQ ID NO: 336261 - protein, 17 aa, Artificial Sequence
  Description of Artificial Sequence: Synthetic peptide
  Seed: RYGSFSVTLDIVQGIES (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXES

SEQ ID NO: 336262 - protein, 18 aa, Artificial Sequence
  Description of Artificial Sequence: Synthetic peptide
  Seed: RYGSFSVTLDIVQGIESA (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIESA

SEQ ID NO: 336263 - protein, 18 aa, Artificial Sequence
  Description of Artificial Sequence: Synthetic peptide
  Seed: RYGSFSVTLDIVQGIESA (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXESA

SEQ ID NO: 336264 - protein, 18 aa, Artificial Sequence
  Description of Artificial Sequence: Synthetic peptide
  Seed: RYGSFSVTLDIVQGIESA (PMEL_HUMAN)
  Core: LDIVQGIES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTXDIXQXIEXA

SEQ ID NO: 336265 - protein, 19 aa, Artificial Sequence
  Description of Artificial Sequence: Synthetic peptide
  Seed: RYGSFSVTLDIVQGIESAE (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIESAE

SEQ ID NO: 336266 - protein, 19 aa, Artificial Sequence
  Description of Artificial Sequence: Synthetic peptide
  Seed: RYGSFSVTLDIVQGIESAE (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXESAE

SEQ ID NO: 336267 - protein, 19 aa, Artificial Sequence
  Description of Artificial Sequence: Synthetic peptide
  Seed: RYGSFSVTLDIVQGIESAE (PMEL_HUMAN)
  Core: LDIVQGIES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTXDIXQXIEXAE

SEQ ID NO: 336268 - protein, 20 aa, Artificial Sequence
  Description of Artificial Sequence: Synthetic peptide
  Seed: RYGSFSVTLDIVQGIESAEI (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIESAEI

SEQ ID NO: 336269 - protein, 20 aa, Artificial Sequence
  Description of Artificial Sequence: Synthetic peptide
  Seed: RYGSFSVTLDIVQGIESAEI (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXESAEI

SEQ ID NO: 336270 - protein, 20 aa, Artificial Sequence
  Description of Artificial Sequence: Synthetic peptide
  Seed: RYGSFSVTLDIVQGIESAEI (PMEL_HUMAN)
  Core: LDIVQGIES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTXDIXQXIEXAEI

SEQ ID NO: 336271 - protein, 20 aa, Artificial Sequence
  Description of Artificial Sequence: Synthetic peptide
  Seed: RYGSFSVTLDIVQGIESAEI (PMEL_HUMAN)
  Core: VQGIESAEI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTLDIXQGXEXAEX

SEQ ID NO: 336272 - protein, 21 aa, Artificial Sequence
  Description of Artificial Sequence: Synthetic peptide
  Seed: RYGSFSVTLDIVQGIESAEIL (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIESAEIL

SEQ ID NO: 336273 - protein, 21 aa, Artificial Sequence
  Description of Artificial Sequence: Synthetic peptide
  Seed: RYGSFSVTLDIVQGIESAEIL (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXESAEIL

SEQ ID NO: 336274 - protein, 21 aa, Artificial Sequence
  Description of Artificial Sequence: Synthetic peptide
  Seed: RYGSFSVTLDIVQGIESAEIL (PMEL_HUMAN)
  Core: LDIVQGIES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTXDIXQXIEXAEIL

SEQ ID NO: 336275 - protein, 21 aa, Artificial Sequence
  Description of Artificial Sequence: Synthetic peptide
  Seed: RYGSFSVTLDIVQGIESAEIL (PMEL_HUMAN)
  Core: VQGIESAEI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTLDIXQGXEXAEXL

SEQ ID NO: 336276 - protein, 22 aa, Artificial Sequence
  Description of Artificial Sequence: Synthetic peptide
  Seed: RYGSFSVTLDIVQGIESAEILQ (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIESAEILQ

SEQ ID NO: 336277 - protein, 22 aa, Artificial Sequence
  Description of Artificial Sequence: Synthetic peptide
  Seed: RYGSFSVTLDIVQGIESAEILQ (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXESAEILQ

SEQ ID NO: 336278 - protein, 22 aa, Artificial Sequence
  Description of Artificial Sequence: Synthetic peptide
  Seed: RYGSFSVTLDIVQGIESAEILQ (PMEL_HUMAN)
  Core: LDIVQGIES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTXDIXQXIEXAEILQ

SEQ ID NO: 336279 - protein, 22 aa, Artificial Sequence
  Description of Artificial Sequence: Synthetic peptide
  Seed: RYGSFSVTLDIVQGIESAEILQ (PMEL_HUMAN)
  Core: VQGIESAEI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTLDIXQGXEXAEXLQ

SEQ ID NO: 336280 - protein, 23 aa, Artificial Sequence
  Description of Artificial Sequence: Synthetic peptide
  Seed: RYGSFSVTLDIVQGIESAEILQA (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIESAEILQA

SEQ ID NO: 336281 - protein, 23 aa, Artificial Sequence
  Description of Artificial Sequence: Synthetic peptide
  Seed: RYGSFSVTLDIVQGIESAEILQA (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXESAEILQA

SEQ ID NO: 336282 - protein, 23 aa, Artificial Sequence
  Description of Artificial Sequence: Synthetic peptide
  Seed: RYGSFSVTLDIVQGIESAEILQA (PMEL_HUMAN)
  Core: LDIVQGIES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTXDIXQXIEXAEILQA

SEQ ID NO: 336283 - protein, 23 aa, Artificial Sequence
  Description of Artificial Sequence: Synthetic peptide
  Seed: RYGSFSVTLDIVQGIESAEILQA (PMEL_HUMAN)
  Core: VQGIESAEI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTLDIXQGXEXAEXLQA

SEQ ID NO: 336284 - protein, 23 aa, Artificial Sequence
  Description of Artificial Sequence: Synthetic peptide
  Seed: RYGSFSVTLDIVQGIESAEILQA (PMEL_HUMAN)
  Core: IESAEILQA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTLDIVQGXESXEXLQX

SEQ ID NO: 336285 - protein, 24 aa, Artificial Sequence
  Description of Artificial Sequence: Synthetic peptide
  Seed: RYGSFSVTLDIVQGIESAEILQAV (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIESAEILQAV

SEQ ID NO: 336286 - protein, 24 aa, Artificial Sequence
  Description of Artificial Sequence: Synthetic peptide
  Seed: RYGSFSVTLDIVQGIESAEILQAV (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXESAEILQAV

SEQ ID NO: 336287 - protein, 24 aa, Artificial Sequence
  Description of Artificial Sequence: Synthetic peptide
  Seed: RYGSFSVTLDIVQGIESAEILQAV (PMEL_HUMAN)
  Core: LDIVQGIES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTXDIXQXIEXAEILQAV

SEQ ID NO: 336288 - protein, 24 aa, Artificial Sequence
  Description of Artificial Sequence: Synthetic peptide
  Seed: RYGSFSVTLDIVQGIESAEILQAV (PMEL_HUMAN)
  Core: VQGIESAEI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTLDIXQGXEXAEXLQAV

SEQ ID NO: 336289 - protein, 24 aa, Artificial Sequence
  Description of Artificial Sequence: Synthetic peptide
  Seed: RYGSFSVTLDIVQGIESAEILQAV (PMEL_HUMAN)
  Core: IESAEILQA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTLDIVQGXESXEXLQXV

SEQ ID NO: 336290 - protein, 25 aa, Artificial Sequence
  Description of Artificial Sequence: Synthetic peptide
  Seed: RYGSFSVTLDIVQGIESAEILQAVP (PMEL_HUMAN)
  Core: FSVTLDIVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
RYGSXSVXLXIVXGIESAEILQAVP

SEQ ID NO: 336291 - protein, 25 aa, Artificial Sequence
  Description of Artificial Sequence: Synthetic peptide
  Seed: RYGSFSVTLDIVQGIESAEILQAVP (PMEL_HUMAN)
  Core: VTLDIVQGI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSXTLXIXQGXESAEILQAVP

SEQ ID NO: 336292 - protein, 25 aa, Artificial Sequence
  Description of Artificial Sequence: Synthetic peptide
  Seed: RYGSFSVTLDIVQGIESAEILQAVP (PMEL_HUMAN)
  Core: LDIVQGIES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTXDIXQXIEXAEILQAVP

SEQ ID NO: 336293 - protein, 25 aa, Artificial Sequence
  Description of Artificial Sequence: Synthetic peptide
  Seed: RYGSFSVTLDIVQGIESAEILQAVP (PMEL_HUMAN)
  Core: VQGIESAEI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTLDIXQGXEXAEXLQAVP

SEQ ID NO: 336294 - protein, 25 aa, Artificial Sequence
  Description of Artificial Sequence: Synthetic peptide
  Seed: RYGSFSVTLDIVQGIESAEILQAVP (PMEL_HUMAN)
  Core: IESAEILQA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
RYGSFSVTLDIVQGXESXEXLQXVP

SEQ ID NO: 336295 - protein, 14 aa, Artificial Sequence
  Description of Artificial Sequence: Synthetic peptide
  Seed: SAEILQAVPSGEGD (PMEL_HUMAN)
  Core: ILQAVPSGE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SAEXLQXVXSGXGD

SEQ ID NO: 336296 - protein, 15 aa, Artificial Sequence
  Description of Artificial Sequence: Synthetic peptide
  Seed: SAEILQAVPSGEGDA (PMEL_HUMAN)
  Core: ILQAVPSGE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SAEXLQXVXSGXGDA

SEQ ID NO: 336297 - protein, 15 aa, Artificial Sequence
  Description of Artificial Sequence: Synthetic peptide
  Seed: SAEILQAVPSGEGDA (PMEL_HUMAN)
  Core: LQAVPSGEG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAEIXQAXPXGEXDA

SEQ ID NO: 336298 - protein, 16 aa, Artificial Sequence
  Description of Artificial Sequence: Synthetic peptide
  Seed: SAEILQAVPSGEGDAF (PMEL_HUMAN)
  Core: ILQAVPSGE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SAEXLQXVXSGXGDAF

SEQ ID NO: 336299 - protein, 16 aa, Artificial Sequence
  Description of Artificial Sequence: Synthetic peptide
  Seed: SAEILQAVPSGEGDAF (PMEL_HUMAN)
  Core: LQAVPSGEG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAEIXQAXPXGEXDAF

SEQ ID NO: 336300 - protein, 17 aa, Artificial Sequence
  Description of Artificial Sequence: Synthetic peptide
  Seed: SAEILQAVPSGEGDAFE (PMEL_HUMAN)
  Core: ILQAVPSGE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SAEXLQXVXSGXGDAFE

SEQ ID NO: 336301 - protein, 17 aa, Artificial Sequence
  Description of Artificial Sequence: Synthetic peptide
  Seed: SAEILQAVPSGEGDAFE (PMEL_HUMAN)
  Core: LQAVPSGEG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAEIXQAXPXGEXDAFE

SEQ ID NO: 336302 - protein, 20 aa, Artificial Sequence
  Description of Artificial Sequence: Synthetic peptide
  Seed: SAEILQAVPSGEGDAFELTV (PMEL_HUMAN)
  Core: ILQAVPSGE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SAEXLQXVXSGXGDAFELTV

SEQ ID NO: 336303 - protein, 20 aa, Artificial Sequence
  Description of Artificial Sequence: Synthetic peptide
  Seed: SAEILQAVPSGEGDAFELTV (PMEL_HUMAN)
  Core: LQAVPSGEG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAEIXQAXPXGEXDAFELTV

SEQ ID NO: 336304 - protein, 14 aa, Artificial Sequence
  Description of Artificial Sequence: Synthetic peptide
  Seed: SAFTITDQVPFSVS (PMEL_HUMAN)
  Core: FTITDQVPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SAXTIXDXVPXSVS

SEQ ID NO: 336305 - protein, 14 aa, Artificial Sequence
  Description of Artificial Sequence: Synthetic peptide
  Seed: SAFTITDQVPFSVS (PMEL_HUMAN)
  Core: ITDQVPFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAFTXTDXVXFSXS

SEQ ID NO: 336306 - protein, 15 aa, Artificial Sequence
  Description of Artificial Sequence: Synthetic peptide
  Seed: SAFTITDQVPFSVSV (PMEL_HUMAN)
  Core: FTITDQVPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SAXTIXDXVPXSVSV

SEQ ID NO: 336307 - protein, 15 aa, Artificial Sequence
  Description of Artificial Sequence: Synthetic peptide
  Seed: SAFTITDQVPFSVSV (PMEL_HUMAN)
  Core: TITDQVPFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SAFXITXQXPFXVSV

SEQ ID NO: 336308 - protein, 15 aa, Artificial Sequence
  Description of Artificial Sequence: Synthetic peptide
  Seed: SAFTITDQVPFSVSV (PMEL_HUMAN)
  Core: ITDQVPFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAFTXTDXVXFSXSV

SEQ ID NO: 336309 - protein, 16 aa, Artificial Sequence
  Description of Artificial Sequence: Synthetic peptide
  Seed: SAFTITDQVPFSVSVS (PMEL_HUMAN)
  Core: FTITDQVPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SAXTIXDXVPXSVSVS

SEQ ID NO: 336310 - protein, 16 aa, Artificial Sequence
  Description of Artificial Sequence: Synthetic peptide
  Seed: SAFTITDQVPFSVSVS (PMEL_HUMAN)
  Core: ITDQVPFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAFTXTDXVXFSXSVS

SEQ ID NO: 336311 - protein, 17 aa, Artificial Sequence
  Description of Artificial Sequence: Synthetic peptide
  Seed: SAFTITDQVPFSVSVSQ (PMEL_HUMAN)
  Core: FTITDQVPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SAXTIXDXVPXSVSVSQ

SEQ ID NO: 336312 - protein, 17 aa, Artificial Sequence
  Description of Artificial Sequence: Synthetic peptide
  Seed: SAFTITDQVPFSVSVSQ (PMEL_HUMAN)
  Core: ITDQVPFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAFTXTDXVXFSXSVSQ

SEQ ID NO: 336313 - protein, 18 aa, Artificial Sequence
  Description of Artificial Sequence: Synthetic peptide
  Seed: SAFTITDQVPFSVSVSQL (PMEL_HUMAN)
  Core: ITDQVPFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAFTXTDXVXFSXSVSQL

SEQ ID NO: 336314 - protein, 19 aa, Artificial Sequence
  Description of Artificial Sequence: Synthetic peptide
  Seed: SAFTITDQVPFSVSVSQLR (PMEL_HUMAN)
  Core: FTITDQVPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SAXTIXDXVPXSVSVSQLR

SEQ ID NO: 336315 - protein, 19 aa, Artificial Sequence
  Description of Artificial Sequence: Synthetic peptide
  Seed: SAFTITDQVPFSVSVSQLR (PMEL_HUMAN)
  Core: ITDQVPFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAFTXTDXVXFSXSVSQLR

SEQ ID NO: 336316 - protein, 19 aa, Artificial Sequence
  Description of Artificial Sequence: Synthetic peptide
  Seed: SAFTITDQVPFSVSVSQLR (PMEL_HUMAN)
  Core: TDQVPFSVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SAFTIXDQXPXSVXVSQLR

SEQ ID NO: 336317 - protein, 19 aa, Artificial Sequence
  Description of Artificial Sequence: Synthetic peptide
  Seed: SAFTITDQVPFSVSVSQLR (PMEL_HUMAN)
  Core: QVPFSVSVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDXVPXSXSVXQLR

SEQ ID NO: 336318 - protein, 19 aa, Artificial Sequence
  Description of Artificial Sequence: Synthetic peptide
  Seed: SAFTITDQVPFSVSVSQLR (PMEL_HUMAN)
  Core: PFSVSVSQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVXFSXSXSQXR

SEQ ID NO: 336319 - protein, 20 aa, Artificial Sequence
  Description of Artificial Sequence: Synthetic peptide
  Seed: SAFTITDQVPFSVSVSQLRA (PMEL_HUMAN)
  Core: FTITDQVPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SAXTIXDXVPXSVSVSQLRA

SEQ ID NO: 336320 - protein, 20 aa, Artificial Sequence
  Description of Artificial Sequence: Synthetic peptide
  Seed: SAFTITDQVPFSVSVSQLRA (PMEL_HUMAN)
  Core: ITDQVPFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAFTXTDXVXFSXSVSQLRA

SEQ ID NO: 336321 - protein, 20 aa, Artificial Sequence
  Description of Artificial Sequence: Synthetic peptide
  Seed: SAFTITDQVPFSVSVSQLRA (PMEL_HUMAN)
  Core: QVPFSVSVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDXVPXSXSVXQLRA

SEQ ID NO: 336322 - protein, 20 aa, Artificial Sequence
  Description of Artificial Sequence: Synthetic peptide
  Seed: SAFTITDQVPFSVSVSQLRA (PMEL_HUMAN)
  Core: PFSVSVSQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVXFSXSXSQXRA

SEQ ID NO: 336323 - protein, 20 aa, Artificial Sequence
  Description of Artificial Sequence: Synthetic peptide
  Seed: SAFTITDQVPFSVSVSQLRA (PMEL_HUMAN)
  Core: FSVSVSQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPXSVXVXQLXA

SEQ ID NO: 336324 - protein, 21 aa, Artificial Sequence
  Description of Artificial Sequence: Synthetic peptide
  Seed: SAFTITDQVPFSVSVSQLRAL (PMEL_HUMAN)
  Core: FTITDQVPF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SAXTIXDXVPXSVSVSQLRAL

SEQ ID NO: 336325 - protein, 21 aa, Artificial Sequence
  Description of Artificial Sequence: Synthetic peptide
  Seed: SAFTITDQVPFSVSVSQLRAL (PMEL_HUMAN)
  Core: ITDQVPFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SAFTXTDXVXFSXSVSQLRAL

SEQ ID NO: 336326 - protein, 21 aa, Artificial Sequence
  Description of Artificial Sequence: Synthetic peptide
  Seed: SAFTITDQVPFSVSVSQLRAL (PMEL_HUMAN)
  Core: QVPFSVSVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDXVPXSXSVXQLRAL

SEQ ID NO: 336327 - protein, 21 aa, Artificial Sequence
  Description of Artificial Sequence: Synthetic peptide
  Seed: SAFTITDQVPFSVSVSQLRAL (PMEL_HUMAN)
  Core: PFSVSVSQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVXFSXSXSQXRAL

SEQ ID NO: 336328 - protein, 21 aa, Artificial Sequence
  Description of Artificial Sequence: Synthetic peptide
  Seed: SAFTITDQVPFSVSVSQLRAL (PMEL_HUMAN)
  Core: FSVSVSQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPXSVXVXQLXAL

SEQ ID NO: 336329 - protein, 21 aa, Artificial Sequence
  Description of Artificial Sequence: Synthetic peptide
  Seed: SAFTITDQVPFSVSVSQLRAL (PMEL_HUMAN)
  Core: VSVSQLRAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPFSXSVXQXRAX

SEQ ID NO: 336330 - protein, 22 aa, Artificial Sequence
  Description of Artificial Sequence: Synthetic peptide
  Seed: SAFTITDQVPFSVSVSQLRALD (PMEL_HUMAN)
  Core: QVPFSVSVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDXVPXSXSVXQLRALD

SEQ ID NO: 336331 - protein, 22 aa, Artificial Sequence
  Description of Artificial Sequence: Synthetic peptide
  Seed: SAFTITDQVPFSVSVSQLRALD (PMEL_HUMAN)
  Core: PFSVSVSQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVXFSXSXSQXRALD

SEQ ID NO: 336332 - protein, 22 aa, Artificial Sequence
  Description of Artificial Sequence: Synthetic peptide
  Seed: SAFTITDQVPFSVSVSQLRALD (PMEL_HUMAN)
  Core: FSVSVSQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPXSVXVXQLXALD

SEQ ID NO: 336333 - protein, 22 aa, Artificial Sequence
  Description of Artificial Sequence: Synthetic peptide
  Seed: SAFTITDQVPFSVSVSQLRALD (PMEL_HUMAN)
  Core: VSVSQLRAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPFSXSVXQXRAXD

SEQ ID NO: 336334 - protein, 23 aa, Artificial Sequence
  Description of Artificial Sequence: Synthetic peptide
  Seed: SAFTITDQVPFSVSVSQLRALDG (PMEL_HUMAN)
  Core: QVPFSVSVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDXVPXSXSVXQLRALDG

SEQ ID NO: 336335 - protein, 23 aa, Artificial Sequence
  Description of Artificial Sequence: Synthetic peptide
  Seed: SAFTITDQVPFSVSVSQLRALDG (PMEL_HUMAN)
  Core: PFSVSVSQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVXFSXSXSQXRALDG

SEQ ID NO: 336336 - protein, 23 aa, Artificial Sequence
  Description of Artificial Sequence: Synthetic peptide
  Seed: SAFTITDQVPFSVSVSQLRALDG (PMEL_HUMAN)
  Core: FSVSVSQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPXSVXVXQLXALDG

SEQ ID NO: 336337 - protein, 23 aa, Artificial Sequence
  Description of Artificial Sequence: Synthetic peptide
  Seed: SAFTITDQVPFSVSVSQLRALDG (PMEL_HUMAN)
  Core: VSVSQLRAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPFSXSVXQXRAXDG

SEQ ID NO: 336338 - protein, 24 aa, Artificial Sequence
  Description of Artificial Sequence: Synthetic peptide
  Seed: SAFTITDQVPFSVSVSQLRALDGG (PMEL_HUMAN)
  Core: QVPFSVSVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDXVPXSXSVXQLRALDGG

SEQ ID NO: 336339 - protein, 24 aa, Artificial Sequence
  Description of Artificial Sequence: Synthetic peptide
  Seed: SAFTITDQVPFSVSVSQLRALDGG (PMEL_HUMAN)
  Core: PFSVSVSQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVXFSXSXSQXRALDGG

SEQ ID NO: 336340 - protein, 24 aa, Artificial Sequence
  Description of Artificial Sequence: Synthetic peptide
  Seed: SAFTITDQVPFSVSVSQLRALDGG (PMEL_HUMAN)
  Core: FSVSVSQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPXSVXVXQLXALDGG

SEQ ID NO: 336341 - protein, 24 aa, Artificial Sequence
  Description of Artificial Sequence: Synthetic peptide
  Seed: SAFTITDQVPFSVSVSQLRALDGG (PMEL_HUMAN)
  Core: VSVSQLRAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPFSXSVXQXRAXDGG

SEQ ID NO: 336342 - protein, 24 aa, Artificial Sequence
  Description of Artificial Sequence: Synthetic peptide
  Seed: SAFTITDQVPFSVSVSQLRALDGG (PMEL_HUMAN)
  Core: VSQLRALDG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPFSVSXSQXRXLDXG

SEQ ID NO: 336343 - protein, 25 aa, Artificial Sequence
  Description of Artificial Sequence: Synthetic peptide
  Seed: SAFTITDQVPFSVSVSQLRALDGGN (PMEL_HUMAN)
  Core: QVPFSVSVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDXVPXSXSVXQLRALDGGN

SEQ ID NO: 336344 - protein, 25 aa, Artificial Sequence
  Description of Artificial Sequence: Synthetic peptide
  Seed: SAFTITDQVPFSVSVSQLRALDGGN (PMEL_HUMAN)
  Core: PFSVSVSQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVXFSXSXSQXRALDGGN

SEQ ID NO: 336345 - protein, 25 aa, Artificial Sequence
  Description of Artificial Sequence: Synthetic peptide
  Seed: SAFTITDQVPFSVSVSQLRALDGGN (PMEL_HUMAN)
  Core: FSVSVSQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPXSVXVXQLXALDGGN

SEQ ID NO: 336346 - protein, 25 aa, Artificial Sequence
  Description of Artificial Sequence: Synthetic peptide
  Seed: SAFTITDQVPFSVSVSQLRALDGGN (PMEL_HUMAN)
  Core: VSVSQLRAL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPFSXSVXQXRAXDGGN

SEQ ID NO: 336347 - protein, 25 aa, Artificial Sequence
  Description of Artificial Sequence: Synthetic peptide
  Seed: SAFTITDQVPFSVSVSQLRALDGGN (PMEL_HUMAN)
  Core: VSQLRALDG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SAFTITDQVPFSVSXSQXRXLDXGN

SEQ ID NO: 336348 - protein, 14 aa, Artificial Sequence
  Description of Artificial Sequence: Synthetic peptide
  Seed: SCQGGLPKEACMEI (PMEL_HUMAN)
  Core: CQGGLPKEA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXQGXLXKEXCMEI

SEQ ID NO: 336349 - protein, 15 aa, Artificial Sequence
  Description of Artificial Sequence: Synthetic peptide
  Seed: SCQGGLPKEACMEIS (PMEL_HUMAN)
  Core: CQGGLPKEA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXQGXLXKEXCMEIS

SEQ ID NO: 336350 - protein, 16 aa, Artificial Sequence
  Description of Artificial Sequence: Synthetic peptide
  Seed: SCQGGLPKEACMEISS (PMEL_HUMAN)
  Core: CQGGLPKEA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXQGXLXKEXCMEISS

SEQ ID NO: 336351 - protein, 17 aa, Artificial Sequence
  Description of Artificial Sequence: Synthetic peptide
  Seed: SCQGGLPKEACMEISSP (PMEL_HUMAN)
  Core: CQGGLPKEA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXQGXLXKEXCMEISSP

SEQ ID NO: 336352 - protein, 20 aa, Artificial Sequence
  Description of Artificial Sequence: Synthetic peptide
  Seed: SCQGGLPKEACMEISSPGCQ (PMEL_HUMAN)
  Core: PKEACMEIS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SCQGGLXKEXCXEIXSPGCQ

SEQ ID NO: 336353 - protein, 13 aa, Artificial Sequence
  Description of Artificial Sequence: Synthetic peptide
  Seed: SEVMGTTLAEMST (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXST

SEQ ID NO: 336354 - protein, 14 aa, Artificial Sequence
  Description of Artificial Sequence: Synthetic peptide
  Seed: SEVMGTTLAEMSTP (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTP

SEQ ID NO: 336355 - protein, 14 aa, Artificial Sequence
  Description of Artificial Sequence: Synthetic peptide
  Seed: SEVMGTTLAEMSTP (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTP

SEQ ID NO: 336356 - protein, 15 aa, Artificial Sequence
  Description of Artificial Sequence: Synthetic peptide
  Seed: SEVMGTTLAEMSTPE (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPE

SEQ ID NO: 336357 - protein, 15 aa, Artificial Sequence
  Description of Artificial Sequence: Synthetic peptide
  Seed: SEVMGTTLAEMSTPE (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPE

SEQ ID NO: 336358 - protein, 16 aa, Artificial Sequence
  Description of Artificial Sequence: Synthetic peptide
  Seed: SEVMGTTLAEMSTPEA (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEA

SEQ ID NO: 336359 - protein, 16 aa, Artificial Sequence
  Description of Artificial Sequence: Synthetic peptide
  Seed: SEVMGTTLAEMSTPEA (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEA

SEQ ID NO: 336360 - protein, 17 aa, Artificial Sequence
  Description of Artificial Sequence: Synthetic peptide
  Seed: SEVMGTTLAEMSTPEAT (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEAT

SEQ ID NO: 336361 - protein, 17 aa, Artificial Sequence
  Description of Artificial Sequence: Synthetic peptide
  Seed: SEVMGTTLAEMSTPEAT (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEAT

SEQ ID NO: 336362 - protein, 17 aa, Artificial Sequence
  Description of Artificial Sequence: Synthetic peptide
  Seed: SEVMGTTLAEMSTPEAT (PMEL_HUMAN)
  Core: LAEMSTPEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTXAEXSXPEXT

SEQ ID NO: 336363 - protein, 18 aa, Artificial Sequence
  Description of Artificial Sequence: Synthetic peptide
  Seed: SEVMGTTLAEMSTPEATG (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEATG

SEQ ID NO: 336364 - protein, 18 aa, Artificial Sequence
  Description of Artificial Sequence: Synthetic peptide
  Seed: SEVMGTTLAEMSTPEATG (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEATG

SEQ ID NO: 336365 - protein, 18 aa, Artificial Sequence
  Description of Artificial Sequence: Synthetic peptide
  Seed: SEVMGTTLAEMSTPEATG (PMEL_HUMAN)
  Core: AEMSTPEAT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTLXEMXTXEAXG

SEQ ID NO: 336366 - protein, 19 aa, Artificial Sequence
  Description of Artificial Sequence: Synthetic peptide
  Seed: SEVMGTTLAEMSTPEATGM (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEATGM

SEQ ID NO: 336367 - protein, 19 aa, Artificial Sequence
  Description of Artificial Sequence: Synthetic peptide
  Seed: SEVMGTTLAEMSTPEATGM (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEATGM

SEQ ID NO: 336368 - protein, 19 aa, Artificial Sequence
  Description of Artificial Sequence: Synthetic peptide
  Seed: SEVMGTTLAEMSTPEATGM (PMEL_HUMAN)
  Core: LAEMSTPEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTXAEXSXPEXTGM

SEQ ID NO: 336369 - protein, 19 aa, Artificial Sequence
  Description of Artificial Sequence: Synthetic peptide
  Seed: SEVMGTTLAEMSTPEATGM (PMEL_HUMAN)
  Core: AEMSTPEAT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTLXEMXTXEAXGM

SEQ ID NO: 336370 - protein, 20 aa, Artificial Sequence
  Description of Artificial Sequence: Synthetic peptide
  Seed: SEVMGTTLAEMSTPEATGMT (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEATGMT

SEQ ID NO: 336371 - protein, 20 aa, Artificial Sequence
  Description of Artificial Sequence: Synthetic peptide
  Seed: SEVMGTTLAEMSTPEATGMT (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEATGMT

SEQ ID NO: 336372 - protein, 20 aa, Artificial Sequence
  Description of Artificial Sequence: Synthetic peptide
  Seed: SEVMGTTLAEMSTPEATGMT (PMEL_HUMAN)
  Core: LAEMSTPEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTXAEXSXPEXTGMT

SEQ ID NO: 336373 - protein, 20 aa, Artificial Sequence
  Description of Artificial Sequence: Synthetic peptide
  Seed: SEVMGTTLAEMSTPEATGMT (PMEL_HUMAN)
  Core: AEMSTPEAT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTLXEMXTXEAXGMT

SEQ ID NO: 336374 - protein, 21 aa, Artificial Sequence
  Description of Artificial Sequence: Synthetic peptide
  Seed: SEVMGTTLAEMSTPEATGMTP (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEATGMTP

SEQ ID NO: 336375 - protein, 21 aa, Artificial Sequence
  Description of Artificial Sequence: Synthetic peptide
  Seed: SEVMGTTLAEMSTPEATGMTP (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEATGMTP

SEQ ID NO: 336376 - protein, 21 aa, Artificial Sequence
  Description of Artificial Sequence: Synthetic peptide
  Seed: SEVMGTTLAEMSTPEATGMTP (PMEL_HUMAN)
  Core: LAEMSTPEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTXAEXSXPEXTGMTP

SEQ ID NO: 336377 - protein, 21 aa, Artificial Sequence
  Description of Artificial Sequence: Synthetic peptide
  Seed: SEVMGTTLAEMSTPEATGMTP (PMEL_HUMAN)
  Core: AEMSTPEAT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTLXEMXTXEAXGMTP

SEQ ID NO: 336378 - protein, 22 aa, Artificial Sequence
  Description of Artificial Sequence: Synthetic peptide
  Seed: SEVMGTTLAEMSTPEATGMTPA (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEATGMTPA

SEQ ID NO: 336379 - protein, 22 aa, Artificial Sequence
  Description of Artificial Sequence: Synthetic peptide
  Seed: SEVMGTTLAEMSTPEATGMTPA (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEATGMTPA

SEQ ID NO: 336380 - protein, 22 aa, Artificial Sequence
  Description of Artificial Sequence: Synthetic peptide
  Seed: SEVMGTTLAEMSTPEATGMTPA (PMEL_HUMAN)
  Core: LAEMSTPEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTXAEXSXPEXTGMTPA

SEQ ID NO: 336381 - protein, 22 aa, Artificial Sequence
  Description of Artificial Sequence: Synthetic peptide
  Seed: SEVMGTTLAEMSTPEATGMTPA (PMEL_HUMAN)
  Core: AEMSTPEAT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTLXEMXTXEAXGMTPA

SEQ ID NO: 336382 - protein, 23 aa, Artificial Sequence
  Description of Artificial Sequence: Synthetic peptide
  Seed: SEVMGTTLAEMSTPEATGMTPAE (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEATGMTPAE

SEQ ID NO: 336383 - protein, 23 aa, Artificial Sequence
  Description of Artificial Sequence: Synthetic peptide
  Seed: SEVMGTTLAEMSTPEATGMTPAE (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEATGMTPAE

SEQ ID NO: 336384 - protein, 23 aa, Artificial Sequence
  Description of Artificial Sequence: Synthetic peptide
  Seed: SEVMGTTLAEMSTPEATGMTPAE (PMEL_HUMAN)
  Core: LAEMSTPEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTXAEXSXPEXTGMTPAE

SEQ ID NO: 336385 - protein, 23 aa, Artificial Sequence
  Description of Artificial Sequence: Synthetic peptide
  Seed: SEVMGTTLAEMSTPEATGMTPAE (PMEL_HUMAN)
  Core: AEMSTPEAT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTLXEMXTXEAXGMTPAE

SEQ ID NO: 336386 - protein, 24 aa, Artificial Sequence
  Description of Artificial Sequence: Synthetic peptide
  Seed: SEVMGTTLAEMSTPEATGMTPAEV (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEATGMTPAEV

SEQ ID NO: 336387 - protein, 24 aa, Artificial Sequence
  Description of Artificial Sequence: Synthetic peptide
  Seed: SEVMGTTLAEMSTPEATGMTPAEV (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEATGMTPAEV

SEQ ID NO: 336388 - protein, 24 aa, Artificial Sequence
  Description of Artificial Sequence: Synthetic peptide
  Seed: SEVMGTTLAEMSTPEATGMTPAEV (PMEL_HUMAN)
  Core: LAEMSTPEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTXAEXSXPEXTGMTPAEV

SEQ ID NO: 336389 - protein, 24 aa, Artificial Sequence
  Description of Artificial Sequence: Synthetic peptide
  Seed: SEVMGTTLAEMSTPEATGMTPAEV (PMEL_HUMAN)
  Core: AEMSTPEAT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTLXEMXTXEAXGMTPAEV

SEQ ID NO: 336390 - protein, 25 aa, Artificial Sequence
  Description of Artificial Sequence: Synthetic peptide
  Seed: SEVMGTTLAEMSTPEATGMTPAEVS (PMEL_HUMAN)
  Core: VMGTTLAEM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SEXMGXTXAEXSTPEATGMTPAEVS

SEQ ID NO: 336391 - protein, 25 aa, Artificial Sequence
  Description of Artificial Sequence: Synthetic peptide
  Seed: SEVMGTTLAEMSTPEATGMTPAEVS (PMEL_HUMAN)
  Core: MGTTLAEMS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SEVXGTXLXEMXTPEATGMTPAEVS

SEQ ID NO: 336392 - protein, 25 aa, Artificial Sequence
  Description of Artificial Sequence: Synthetic peptide
  Seed: SEVMGTTLAEMSTPEATGMTPAEVS (PMEL_HUMAN)
  Core: LAEMSTPEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTXAEXSXPEXTGMTPAEVS

SEQ ID NO: 336393 - protein, 25 aa, Artificial Sequence
  Description of Artificial Sequence: Synthetic peptide
  Seed: SEVMGTTLAEMSTPEATGMTPAEVS (PMEL_HUMAN)
  Core: AEMSTPEAT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTLXEMXTXEAXGMTPAEVS

SEQ ID NO: 336394 - protein, 25 aa, Artificial Sequence
  Description of Artificial Sequence: Synthetic peptide
  Seed: SEVMGTTLAEMSTPEATGMTPAEVS (PMEL_HUMAN)
  Core: ATGMTPAEV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SEVMGTTLAEMSTPEXTGXTXAEXS

SEQ ID NO: 336395 - protein, 13 aa, Artificial Sequence
  Description of Artificial Sequence: Synthetic peptide
  Seed: SFSIALNFPGSQK (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQK

SEQ ID NO: 336396 - protein, 13 aa, Artificial Sequence
  Description of Artificial Sequence: Synthetic peptide
  Seed: SFSIALNFPGSQK (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXK

SEQ ID NO: 336397 - protein, 14 aa, Artificial Sequence
  Description of Artificial Sequence: Synthetic peptide
  Seed: SFSIALNFPGSQKV (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKV

SEQ ID NO: 336398 - protein, 14 aa, Artificial Sequence
  Description of Artificial Sequence: Synthetic peptide
  Seed: SFSIALNFPGSQKV (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKV

SEQ ID NO: 336399 - protein, 15 aa, Artificial Sequence
  Description of Artificial Sequence: Synthetic peptide
  Seed: SFSIALNFPGSQKVL (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVL

SEQ ID NO: 336400 - protein, 15 aa, Artificial Sequence
  Description of Artificial Sequence: Synthetic peptide
  Seed: SFSIALNFPGSQKVL (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVL

SEQ ID NO: 336401 - protein, 15 aa, Artificial Sequence
  Description of Artificial Sequence: Synthetic peptide
  Seed: SFSIALNFPGSQKVL (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXL

SEQ ID NO: 336402 - protein, 16 aa, Artificial Sequence
  Description of Artificial Sequence: Synthetic peptide
  Seed: SFSIALNFPGSQKVLP (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLP

SEQ ID NO: 336403 - protein, 16 aa, Artificial Sequence
  Description of Artificial Sequence: Synthetic peptide
  Seed: SFSIALNFPGSQKVLP (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLP

SEQ ID NO: 336404 - protein, 16 aa, Artificial Sequence
  Description of Artificial Sequence: Synthetic peptide
  Seed: SFSIALNFPGSQKVLP (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLP

SEQ ID NO: 336405 - protein, 17 aa, Artificial Sequence
  Description of Artificial Sequence: Synthetic peptide
  Seed: SFSIALNFPGSQKVLPD (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLPD

SEQ ID NO: 336406 - protein, 17 aa, Artificial Sequence
  Description of Artificial Sequence: Synthetic peptide
  Seed: SFSIALNFPGSQKVLPD (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLPD

SEQ ID NO: 336407 - protein, 17 aa, Artificial Sequence
  Description of Artificial Sequence: Synthetic peptide
  Seed: SFSIALNFPGSQKVLPD (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLPD

SEQ ID NO: 336408 - protein, 18 aa, Artificial Sequence
  Description of Artificial Sequence: Synthetic peptide
  Seed: SFSIALNFPGSQKVLPDG (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLPDG

SEQ ID NO: 336409 - protein, 18 aa, Artificial Sequence
  Description of Artificial Sequence: Synthetic peptide
  Seed: SFSIALNFPGSQKVLPDG (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLPDG

SEQ ID NO: 336410 - protein, 18 aa, Artificial Sequence
  Description of Artificial Sequence: Synthetic peptide
  Seed: SFSIALNFPGSQKVLPDG (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLPDG

SEQ ID NO: 336411 - protein, 19 aa, Artificial Sequence
  Description of Artificial Sequence: Synthetic peptide
  Seed: SFSIALNFPGSQKVLPDGQ (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLPDGQ

SEQ ID NO: 336412 - protein, 19 aa, Artificial Sequence
  Description of Artificial Sequence: Synthetic peptide
  Seed: SFSIALNFPGSQKVLPDGQ (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLPDGQ

SEQ ID NO: 336413 - protein, 19 aa, Artificial Sequence
  Description of Artificial Sequence: Synthetic peptide
  Seed: SFSIALNFPGSQKVLPDGQ (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLPDGQ

SEQ ID NO: 336414 - protein, 19 aa, Artificial Sequence
  Description of Artificial Sequence: Synthetic peptide
  Seed: SFSIALNFPGSQKVLPDGQ (PMEL_HUMAN)
  Core: PGSQKVLPD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSIALNFXGSXKXLPXGQ

SEQ ID NO: 336415 - protein, 20 aa, Artificial Sequence
  Description of Artificial Sequence: Synthetic peptide
  Seed: SFSIALNFPGSQKVLPDGQV (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLPDGQV

SEQ ID NO: 336416 - protein, 20 aa, Artificial Sequence
  Description of Artificial Sequence: Synthetic peptide
  Seed: SFSIALNFPGSQKVLPDGQV (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLPDGQV

SEQ ID NO: 336417 - protein, 20 aa, Artificial Sequence
  Description of Artificial Sequence: Synthetic peptide
  Seed: SFSIALNFPGSQKVLPDGQV (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLPDGQV

SEQ ID NO: 336418 - protein, 20 aa, Artificial Sequence
  Description of Artificial Sequence: Synthetic peptide
  Seed: SFSIALNFPGSQKVLPDGQV (PMEL_HUMAN)
  Core: PGSQKVLPD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSIALNFXGSXKXLPXGQV

SEQ ID NO: 336419 - protein, 21 aa, Artificial Sequence
  Description of Artificial Sequence: Synthetic peptide
  Seed: SFSIALNFPGSQKVLPDGQVI (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLPDGQVI

SEQ ID NO: 336420 - protein, 21 aa, Artificial Sequence
  Description of Artificial Sequence: Synthetic peptide
  Seed: SFSIALNFPGSQKVLPDGQVI (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLPDGQVI

SEQ ID NO: 336421 - protein, 21 aa, Artificial Sequence
  Description of Artificial Sequence: Synthetic peptide
  Seed: SFSIALNFPGSQKVLPDGQVI (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLPDGQVI

SEQ ID NO: 336422 - protein, 22 aa, Artificial Sequence
  Description of Artificial Sequence: Synthetic peptide
  Seed: SFSIALNFPGSQKVLPDGQVIW (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLPDGQVIW

SEQ ID NO: 336423 - protein, 22 aa, Artificial Sequence
  Description of Artificial Sequence: Synthetic peptide
  Seed: SFSIALNFPGSQKVLPDGQVIW (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLPDGQVIW

SEQ ID NO: 336424 - protein, 22 aa, Artificial Sequence
  Description of Artificial Sequence: Synthetic peptide
  Seed: SFSIALNFPGSQKVLPDGQVIW (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLPDGQVIW

SEQ ID NO: 336425 - protein, 22 aa, Artificial Sequence
  Description of Artificial Sequence: Synthetic peptide
  Seed: SFSIALNFPGSQKVLPDGQVIW (PMEL_HUMAN)
  Core: QKVLPDGQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSIALNFPGSXKVXPXGQXIW

SEQ ID NO: 336426 - protein, 23 aa, Artificial Sequence
  Description of Artificial Sequence: Synthetic peptide
  Seed: SFSIALNFPGSQKVLPDGQVIWV (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLPDGQVIWV

SEQ ID NO: 336427 - protein, 23 aa, Artificial Sequence
  Description of Artificial Sequence: Synthetic peptide
  Seed: SFSIALNFPGSQKVLPDGQVIWV (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLPDGQVIWV

SEQ ID NO: 336428 - protein, 23 aa, Artificial Sequence
  Description of Artificial Sequence: Synthetic peptide
  Seed: SFSIALNFPGSQKVLPDGQVIWV (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLPDGQVIWV

SEQ ID NO: 336429 - protein, 23 aa, Artificial Sequence
  Description of Artificial Sequence: Synthetic peptide
  Seed: SFSIALNFPGSQKVLPDGQVIWV (PMEL_HUMAN)
  Core: QKVLPDGQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSIALNFPGSXKVXPXGQXIWV

SEQ ID NO: 336430 - protein, 24 aa, Artificial Sequence
  Description of Artificial Sequence: Synthetic peptide
  Seed: SFSIALNFPGSQKVLPDGQVIWVN (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLPDGQVIWVN

SEQ ID NO: 336431 - protein, 24 aa, Artificial Sequence
  Description of Artificial Sequence: Synthetic peptide
  Seed: SFSIALNFPGSQKVLPDGQVIWVN (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLPDGQVIWVN

SEQ ID NO: 336432 - protein, 24 aa, Artificial Sequence
  Description of Artificial Sequence: Synthetic peptide
  Seed: SFSIALNFPGSQKVLPDGQVIWVN (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLPDGQVIWVN

SEQ ID NO: 336433 - protein, 24 aa, Artificial Sequence
  Description of Artificial Sequence: Synthetic peptide
  Seed: SFSIALNFPGSQKVLPDGQVIWVN (PMEL_HUMAN)
  Core: QKVLPDGQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSIALNFPGSXKVXPXGQXIWVN

SEQ ID NO: 336434 - protein, 25 aa, Artificial Sequence
  Description of Artificial Sequence: Synthetic peptide
  Seed: SFSIALNFPGSQKVLPDGQVIWVNN (PMEL_HUMAN)
  Core: FSIALNFPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSIXLXFPXSQKVLPDGQVIWVNN

SEQ ID NO: 336435 - protein, 25 aa, Artificial Sequence
  Description of Artificial Sequence: Synthetic peptide
  Seed: SFSIALNFPGSQKVLPDGQVIWVNN (PMEL_HUMAN)
  Core: IALNFPGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXALXFXGSXKVLPDGQVIWVNN

SEQ ID NO: 336436 - protein, 25 aa, Artificial Sequence
  Description of Artificial Sequence: Synthetic peptide
  Seed: SFSIALNFPGSQKVLPDGQVIWVNN (PMEL_HUMAN)
  Core: LNFPGSQKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSIAXNFXGXQKXLPDGQVIWVNN

SEQ ID NO: 336437 - protein, 25 aa, Artificial Sequence
  Description of Artificial Sequence: Synthetic peptide
  Seed: SFSIALNFPGSQKVLPDGQVIWVNN (PMEL_HUMAN)
  Core: QKVLPDGQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSIALNFPGSXKVXPXGQXIWVNN

SEQ ID NO: 336438 - protein, 25 aa, Artificial Sequence
  Description of Artificial Sequence: Synthetic peptide
  Seed: SFSIALNFPGSQKVLPDGQVIWVNN (PMEL_HUMAN)
  Core: VLPDGQVIW
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SFSIALNFPGSQKXLPXGXVIXVNN

SEQ ID NO: 336439 - protein, 13 aa, Artificial Sequence
  Description of Artificial Sequence: Synthetic peptide
  Seed: SFSVTLDIVQGIE (PMEL_HUMAN)
  Core: VTLDIVQGI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXTLXIXQGXE

SEQ ID NO: 336440 - protein, 14 aa, Artificial Sequence
  Description of Artificial Sequence: Synthetic peptide
  Seed: SFSVTLDIVQGIES (PMEL_HUMAN)
  Core: VTLDIVQGI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXTLXIXQGXES

SEQ ID NO: 336441 - protein, 15 aa, Artificial Sequence
  Description of Artificial Sequence: Synthetic peptide
  Seed: SFSVTLDIVQGIESA (PMEL_HUMAN)
  Core: FSVTLDIVQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSVXLXIVXGIESA

SEQ ID NO: 336442 - protein, 15 aa, Artificial Sequence
  Description of Artificial Sequence: Synthetic peptide
  Seed: SFSVTLDIVQGIESA (PMEL_HUMAN)
  Core: VTLDIVQGI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXTLXIXQGXESA

SEQ ID NO: 336443 - protein, 15 aa, Artificial Sequence
  Description of Artificial Sequence: Synthetic peptide
  Seed: SFSVTLDIVQGIESA (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXA

SEQ ID NO: 336444 - protein, 16 aa, Artificial Sequence
  Description of Artificial Sequence: Synthetic peptide
  Seed: SFSVTLDIVQGIESAE (PMEL_HUMAN)
  Core: VTLDIVQGI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXTLXIXQGXESAE

SEQ ID NO: 336445 - protein, 16 aa, Artificial Sequence
  Description of Artificial Sequence: Synthetic peptide
  Seed: SFSVTLDIVQGIESAE (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXAE

SEQ ID NO: 336446 - protein, 17 aa, Artificial Sequence
  Description of Artificial Sequence: Synthetic peptide
  Seed: SFSVTLDIVQGIESAEI (PMEL_HUMAN)
  Core: VTLDIVQGI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXTLXIXQGXESAEI

SEQ ID NO: 336447 - protein, 17 aa, Artificial Sequence
  Description of Artificial Sequence: Synthetic peptide
  Seed: SFSVTLDIVQGIESAEI (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXAEI

SEQ ID NO: 336448 - protein, 17 aa, Artificial Sequence
  Description of Artificial Sequence: Synthetic peptide
  Seed: SFSVTLDIVQGIESAEI (PMEL_HUMAN)
  Core: VQGIESAEI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIXQGXEXAEX

SEQ ID NO: 336449 - protein, 18 aa, Artificial Sequence
  Description of Artificial Sequence: Synthetic peptide
  Seed: SFSVTLDIVQGIESAEIL (PMEL_HUMAN)
  Core: VTLDIVQGI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXTLXIXQGXESAEIL

SEQ ID NO: 336450 - protein, 18 aa, Artificial Sequence
  Description of Artificial Sequence: Synthetic peptide
  Seed: SFSVTLDIVQGIESAEIL (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXAEIL

SEQ ID NO: 336451 - protein, 18 aa, Artificial Sequence
  Description of Artificial Sequence: Synthetic peptide
  Seed: SFSVTLDIVQGIESAEIL (PMEL_HUMAN)
  Core: VQGIESAEI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIXQGXEXAEXL

SEQ ID NO: 336452 - protein, 19 aa, Artificial Sequence
  Description of Artificial Sequence: Synthetic peptide
  Seed: SFSVTLDIVQGIESAEILQ (PMEL_HUMAN)
  Core: VTLDIVQGI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXTLXIXQGXESAEILQ

SEQ ID NO: 336453 - protein, 19 aa, Artificial Sequence
  Description of Artificial Sequence: Synthetic peptide
  Seed: SFSVTLDIVQGIESAEILQ (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXAEILQ

SEQ ID NO: 336454 - protein, 19 aa, Artificial Sequence
  Description of Artificial Sequence: Synthetic peptide
  Seed: SFSVTLDIVQGIESAEILQ (PMEL_HUMAN)
  Core: VQGIESAEI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIXQGXEXAEXLQ

SEQ ID NO: 336455 - protein, 20 aa, Artificial Sequence
  Description of Artificial Sequence: Synthetic peptide
  Seed: SFSVTLDIVQGIESAEILQA (PMEL_HUMAN)
  Core: VTLDIVQGI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXTLXIXQGXESAEILQA

SEQ ID NO: 336456 - protein, 20 aa, Artificial Sequence
  Description of Artificial Sequence: Synthetic peptide
  Seed: SFSVTLDIVQGIESAEILQA (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXAEILQA

SEQ ID NO: 336457 - protein, 20 aa, Artificial Sequence
  Description of Artificial Sequence: Synthetic peptide
  Seed: SFSVTLDIVQGIESAEILQA (PMEL_HUMAN)
  Core: VQGIESAEI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIXQGXEXAEXLQA

SEQ ID NO: 336458 - protein, 20 aa, Artificial Sequence
  Description of Artificial Sequence: Synthetic peptide
  Seed: SFSVTLDIVQGIESAEILQA (PMEL_HUMAN)
  Core: IESAEILQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIVQGXESXEXLQX

SEQ ID NO: 336459 - protein, 21 aa, Artificial Sequence
  Description of Artificial Sequence: Synthetic peptide
  Seed: SFSVTLDIVQGIESAEILQAV (PMEL_HUMAN)
  Core: VTLDIVQGI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFSXTLXIXQGXESAEILQAV

SEQ ID NO: 336460 - protein, 21 aa, Artificial Sequence
  Description of Artificial Sequence: Synthetic peptide
  Seed: SFSVTLDIVQGIESAEILQAV (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXAEILQAV

SEQ ID NO: 336461 - protein, 21 aa, Artificial Sequence
  Description of Artificial Sequence: Synthetic peptide
  Seed: SFSVTLDIVQGIESAEILQAV (PMEL_HUMAN)
  Core: VQGIESAEI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIXQGXEXAEXLQAV

SEQ ID NO: 336462 - protein, 21 aa, Artificial Sequence
  Description of Artificial Sequence: Synthetic peptide
  Seed: SFSVTLDIVQGIESAEILQAV (PMEL_HUMAN)
  Core: IESAEILQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIVQGXESXEXLQXV

SEQ ID NO: 336463 - protein, 22 aa, Artificial Sequence
  Description of Artificial Sequence: Synthetic peptide
  Seed: SFSVTLDIVQGIESAEILQAVP (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXAEILQAVP

SEQ ID NO: 336464 - protein, 22 aa, Artificial Sequence
  Description of Artificial Sequence: Synthetic peptide
  Seed: SFSVTLDIVQGIESAEILQAVP (PMEL_HUMAN)
  Core: VQGIESAEI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIXQGXEXAEXLQAVP

SEQ ID NO: 336465 - protein, 22 aa, Artificial Sequence
  Description of Artificial Sequence: Synthetic peptide
  Seed: SFSVTLDIVQGIESAEILQAVP (PMEL_HUMAN)
  Core: IESAEILQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIVQGXESXEXLQXVP

SEQ ID NO: 336466 - protein, 23 aa, Artificial Sequence
  Description of Artificial Sequence: Synthetic peptide
  Seed: SFSVTLDIVQGIESAEILQAVPS (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXAEILQAVPS

SEQ ID NO: 336467 - protein, 23 aa, Artificial Sequence
  Description of Artificial Sequence: Synthetic peptide
  Seed: SFSVTLDIVQGIESAEILQAVPS (PMEL_HUMAN)
  Core: VQGIESAEI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIXQGXEXAEXLQAVPS

SEQ ID NO: 336468 - protein, 23 aa, Artificial Sequence
  Description of Artificial Sequence: Synthetic peptide
  Seed: SFSVTLDIVQGIESAEILQAVPS (PMEL_HUMAN)
  Core: IESAEILQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIVQGXESXEXLQXVPS

SEQ ID NO: 336469 - protein, 24 aa, Artificial Sequence
  Description of Artificial Sequence: Synthetic peptide
  Seed: SFSVTLDIVQGIESAEILQAVPSG (PMEL_HUMAN)
  Core: LDIVQGIES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTXDIXQXIEXAEILQAVPSG

SEQ ID NO: 336470 - protein, 24 aa, Artificial Sequence
  Description of Artificial Sequence: Synthetic peptide
  Seed: SFSVTLDIVQGIESAEILQAVPSG (PMEL_HUMAN)
  Core: VQGIESAEI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIXQGXEXAEXLQAVPSG

SEQ ID NO: 336471 - protein, 24 aa, Artificial Sequence
  Description of Artificial Sequence: Synthetic peptide
  Seed: SFSVTLDIVQGIESAEILQAVPSG (PMEL_HUMAN)
  Core: IESAEILQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIVQGXESXEXLQXVPSG

SEQ ID NO: 336472 - protein, 24 aa, Artificial Sequence
  Description of Artificial Sequence: Synthetic peptide
  Seed: SFSVTLDIVQGIESAEILQAVPSG (PMEL_HUMAN)
  Core: ESAEILQAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIVQGIXSAXIXQAXPSG

SEQ ID NO: 336473 - protein, 25 aa, Artificial Sequence
  Description of Artificial Sequence: Synthetic peptide
  Seed: SFSVTLDIVQGIESAEILQAVPSGE (PMEL_HUMAN)
  Core: VQGIESAEI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIXQGXEXAEXLQAVPSGE

SEQ ID NO: 336474 - protein, 25 aa, Artificial Sequence
  Description of Artificial Sequence: Synthetic peptide
  Seed: SFSVTLDIVQGIESAEILQAVPSGE (PMEL_HUMAN)
  Core: IESAEILQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIVQGXESXEXLQXVPSGE

SEQ ID NO: 336475 - protein, 25 aa, Artificial Sequence
  Description of Artificial Sequence: Synthetic peptide
  Seed: SFSVTLDIVQGIESAEILQAVPSGE (PMEL_HUMAN)
  Core: ESAEILQAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIVQGIXSAXIXQAXPSGE

SEQ ID NO: 336476 - protein, 25 aa, Artificial Sequence
  Description of Artificial Sequence: Synthetic peptide
  Seed: SFSVTLDIVQGIESAEILQAVPSGE (PMEL_HUMAN)
  Core: AEILQAVPS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SFSVTLDIVQGIESXEIXQXVPXGE

SEQ ID NO: 336477 - protein, 13 aa, Artificial Sequence
  Description of Artificial Sequence: Synthetic peptide
  Seed: SFVYVWKTWGQYW (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXW

SEQ ID NO: 336478 - protein, 14 aa, Artificial Sequence
  Description of Artificial Sequence: Synthetic peptide
  Seed: SFVYVWKTWGQYWQ (PMEL_HUMAN)
  Core: FVYVWKTWG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVYXWXTWXQYWQ

SEQ ID NO: 336479 - protein, 14 aa, Artificial Sequence
  Description of Artificial Sequence: Synthetic peptide
  Seed: SFVYVWKTWGQYWQ (PMEL_HUMAN)
  Core: VYVWKTWGQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXYVXKXWGXYWQ

SEQ ID NO: 336480 - protein, 14 aa, Artificial Sequence
  Description of Artificial Sequence: Synthetic peptide
  Seed: SFVYVWKTWGQYWQ (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQ

SEQ ID NO: 336481 - protein, 15 aa, Artificial Sequence
  Description of Artificial Sequence: Synthetic peptide
  Seed: SFVYVWKTWGQYWQV (PMEL_HUMAN)
  Core: FVYVWKTWG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVYXWXTWXQYWQV

SEQ ID NO: 336482 - protein, 15 aa, Artificial Sequence
  Description of Artificial Sequence: Synthetic peptide
  Seed: SFVYVWKTWGQYWQV (PMEL_HUMAN)
  Core: VYVWKTWGQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXYVXKXWGXYWQV

SEQ ID NO: 336483 - protein, 15 aa, Artificial Sequence
  Description of Artificial Sequence: Synthetic peptide
  Seed: SFVYVWKTWGQYWQV (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQV

SEQ ID NO: 336484 - protein, 16 aa, Artificial Sequence
  Description of Artificial Sequence: Synthetic peptide
  Seed: SFVYVWKTWGQYWQVL (PMEL_HUMAN)
  Core: FVYVWKTWG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVYXWXTWXQYWQVL

SEQ ID NO: 336485 - protein, 16 aa, Artificial Sequence
  Description of Artificial Sequence: Synthetic peptide
  Seed: SFVYVWKTWGQYWQVL (PMEL_HUMAN)
  Core: VYVWKTWGQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXYVXKXWGXYWQVL

SEQ ID NO: 336486 - protein, 16 aa, Artificial Sequence
  Description of Artificial Sequence: Synthetic peptide
  Seed: SFVYVWKTWGQYWQVL (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVL

SEQ ID NO: 336487 - protein, 17 aa, Artificial Sequence
  Description of Artificial Sequence: Synthetic peptide
  Seed: SFVYVWKTWGQYWQVLG (PMEL_HUMAN)
  Core: FVYVWKTWG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVYXWXTWXQYWQVLG

SEQ ID NO: 336488 - protein, 17 aa, Artificial Sequence
  Description of Artificial Sequence: Synthetic peptide
  Seed: SFVYVWKTWGQYWQVLG (PMEL_HUMAN)
  Core: VYVWKTWGQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXYVXKXWGXYWQVLG

SEQ ID NO: 336489 - protein, 17 aa, Artificial Sequence
  Description of Artificial Sequence: Synthetic peptide
  Seed: SFVYVWKTWGQYWQVLG (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVLG

SEQ ID NO: 336490 - protein, 18 aa, Artificial Sequence
  Description of Artificial Sequence: Synthetic peptide
  Seed: SFVYVWKTWGQYWQVLGG (PMEL_HUMAN)
  Core: VYVWKTWGQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXYVXKXWGXYWQVLGG

SEQ ID NO: 336491 - protein, 18 aa, Artificial Sequence
  Description of Artificial Sequence: Synthetic peptide
  Seed: SFVYVWKTWGQYWQVLGG (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVLGG

SEQ ID NO: 336492 - protein, 19 aa, Artificial Sequence
  Description of Artificial Sequence: Synthetic peptide
  Seed: SFVYVWKTWGQYWQVLGGP (PMEL_HUMAN)
  Core: VYVWKTWGQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXYVXKXWGXYWQVLGGP

SEQ ID NO: 336493 - protein, 19 aa, Artificial Sequence
  Description of Artificial Sequence: Synthetic peptide
  Seed: SFVYVWKTWGQYWQVLGGP (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVLGGP

SEQ ID NO: 336494 - protein, 19 aa, Artificial Sequence
  Description of Artificial Sequence: Synthetic peptide
  Seed: SFVYVWKTWGQYWQVLGGP (PMEL_HUMAN)
  Core: TWGQYWQVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKXWGXYXQVXGGP

SEQ ID NO: 336495 - protein, 19 aa, Artificial Sequence
  Description of Artificial Sequence: Synthetic peptide
  Seed: SFVYVWKTWGQYWQVLGGP (PMEL_HUMAN)
  Core: GQYWQVLGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWXQYXQXLGXP

SEQ ID NO: 336496 - protein, 20 aa, Artificial Sequence
  Description of Artificial Sequence: Synthetic peptide
  Seed: SFVYVWKTWGQYWQVLGGPV (PMEL_HUMAN)
  Core: VYVWKTWGQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXYVXKXWGXYWQVLGGPV

SEQ ID NO: 336497 - protein, 20 aa, Artificial Sequence
  Description of Artificial Sequence: Synthetic peptide
  Seed: SFVYVWKTWGQYWQVLGGPV (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVLGGPV

SEQ ID NO: 336498 - protein, 20 aa, Artificial Sequence
  Description of Artificial Sequence: Synthetic peptide
  Seed: SFVYVWKTWGQYWQVLGGPV (PMEL_HUMAN)
  Core: TWGQYWQVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKXWGXYXQVXGGPV

SEQ ID NO: 336499 - protein, 20 aa, Artificial Sequence
  Description of Artificial Sequence: Synthetic peptide
  Seed: SFVYVWKTWGQYWQVLGGPV (PMEL_HUMAN)
  Core: GQYWQVLGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWXQYXQXLGXPV

SEQ ID NO: 336500 - protein, 20 aa, Artificial Sequence
  Description of Artificial Sequence: Synthetic peptide
  Seed: SFVYVWKTWGQYWQVLGGPV (PMEL_HUMAN)
  Core: YWQVLGGPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQXWQXLXGPX

SEQ ID NO: 336501 - protein, 21 aa, Artificial Sequence
  Description of Artificial Sequence: Synthetic peptide
  Seed: SFVYVWKTWGQYWQVLGGPVS (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVLGGPVS

SEQ ID NO: 336502 - protein, 21 aa, Artificial Sequence
  Description of Artificial Sequence: Synthetic peptide
  Seed: SFVYVWKTWGQYWQVLGGPVS (PMEL_HUMAN)
  Core: TWGQYWQVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKXWGXYXQVXGGPVS

SEQ ID NO: 336503 - protein, 21 aa, Artificial Sequence
  Description of Artificial Sequence: Synthetic peptide
  Seed: SFVYVWKTWGQYWQVLGGPVS (PMEL_HUMAN)
  Core: GQYWQVLGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWXQYXQXLGXPVS

SEQ ID NO: 336504 - protein, 21 aa, Artificial Sequence
  Description of Artificial Sequence: Synthetic peptide
  Seed: SFVYVWKTWGQYWQVLGGPVS (PMEL_HUMAN)
  Core: YWQVLGGPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQXWQXLXGPXS

SEQ ID NO: 336505 - protein, 22 aa, Artificial Sequence
  Description of Artificial Sequence: Synthetic peptide
  Seed: SFVYVWKTWGQYWQVLGGPVSG (PMEL_HUMAN)
  Core: VYVWKTWGQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXYVXKXWGXYWQVLGGPVSG

SEQ ID NO: 336506 - protein, 22 aa, Artificial Sequence
  Description of Artificial Sequence: Synthetic peptide
  Seed: SFVYVWKTWGQYWQVLGGPVSG (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVLGGPVSG

SEQ ID NO: 336507 - protein, 22 aa, Artificial Sequence
  Description of Artificial Sequence: Synthetic peptide
  Seed: SFVYVWKTWGQYWQVLGGPVSG (PMEL_HUMAN)
  Core: GQYWQVLGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWXQYXQXLGXPVSG

SEQ ID NO: 336508 - protein, 22 aa, Artificial Sequence
  Description of Artificial Sequence: Synthetic peptide
  Seed: SFVYVWKTWGQYWQVLGGPVSG (PMEL_HUMAN)
  Core: YWQVLGGPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQXWQXLXGPXSG

SEQ ID NO: 336509 - protein, 22 aa, Artificial Sequence
  Description of Artificial Sequence: Synthetic peptide
  Seed: SFVYVWKTWGQYWQVLGGPVSG (PMEL_HUMAN)
  Core: WQVLGGPVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQYXQVXGXPVXG

SEQ ID NO: 336510 - protein, 23 aa, Artificial Sequence
  Description of Artificial Sequence: Synthetic peptide
  Seed: SFVYVWKTWGQYWQVLGGPVSGL (PMEL_HUMAN)
  Core: VYVWKTWGQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXYVXKXWGXYWQVLGGPVSGL

SEQ ID NO: 336511 - protein, 23 aa, Artificial Sequence
  Description of Artificial Sequence: Synthetic peptide
  Seed: SFVYVWKTWGQYWQVLGGPVSGL (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVLGGPVSGL

SEQ ID NO: 336512 - protein, 23 aa, Artificial Sequence
  Description of Artificial Sequence: Synthetic peptide
  Seed: SFVYVWKTWGQYWQVLGGPVSGL (PMEL_HUMAN)
  Core: GQYWQVLGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWXQYXQXLGXPVSGL

SEQ ID NO: 336513 - protein, 23 aa, Artificial Sequence
  Description of Artificial Sequence: Synthetic peptide
  Seed: SFVYVWKTWGQYWQVLGGPVSGL (PMEL_HUMAN)
  Core: YWQVLGGPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQXWQXLXGPXSGL

SEQ ID NO: 336514 - protein, 23 aa, Artificial Sequence
  Description of Artificial Sequence: Synthetic peptide
  Seed: SFVYVWKTWGQYWQVLGGPVSGL (PMEL_HUMAN)
  Core: WQVLGGPVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQYXQVXGXPVXGL

SEQ ID NO: 336515 - protein, 24 aa, Artificial Sequence
  Description of Artificial Sequence: Synthetic peptide
  Seed: SFVYVWKTWGQYWQVLGGPVSGLS (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVLGGPVSGLS

SEQ ID NO: 336516 - protein, 24 aa, Artificial Sequence
  Description of Artificial Sequence: Synthetic peptide
  Seed: SFVYVWKTWGQYWQVLGGPVSGLS (PMEL_HUMAN)
  Core: GQYWQVLGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWXQYXQXLGXPVSGLS

SEQ ID NO: 336517 - protein, 24 aa, Artificial Sequence
  Description of Artificial Sequence: Synthetic peptide
  Seed: SFVYVWKTWGQYWQVLGGPVSGLS (PMEL_HUMAN)
  Core: YWQVLGGPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQXWQXLXGPXSGLS

SEQ ID NO: 336518 - protein, 24 aa, Artificial Sequence
  Description of Artificial Sequence: Synthetic peptide
  Seed: SFVYVWKTWGQYWQVLGGPVSGLS (PMEL_HUMAN)
  Core: WQVLGGPVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQYXQVXGXPVXGLS

SEQ ID NO: 336519 - protein, 24 aa, Artificial Sequence
  Description of Artificial Sequence: Synthetic peptide
  Seed: SFVYVWKTWGQYWQVLGGPVSGLS (PMEL_HUMAN)
  Core: VLGGPVSGL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQYWQXLGXPXSGXS

SEQ ID NO: 336520 - protein, 25 aa, Artificial Sequence
  Description of Artificial Sequence: Synthetic peptide
  Seed: SFVYVWKTWGQYWQVLGGPVSGLSI (PMEL_HUMAN)
  Core: YVWKTWGQY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SFVXVWXTXGQXWQVLGGPVSGLSI

SEQ ID NO: 336521 - protein, 25 aa, Artificial Sequence
  Description of Artificial Sequence: Synthetic peptide
  Seed: SFVYVWKTWGQYWQVLGGPVSGLSI (PMEL_HUMAN)
  Core: GQYWQVLGG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWXQYXQXLGXPVSGLSI

SEQ ID NO: 336522 - protein, 25 aa, Artificial Sequence
  Description of Artificial Sequence: Synthetic peptide
  Seed: SFVYVWKTWGQYWQVLGGPVSGLSI (PMEL_HUMAN)
  Core: YWQVLGGPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQXWQXLXGPXSGLSI

SEQ ID NO: 336523 - protein, 25 aa, Artificial Sequence
  Description of Artificial Sequence: Synthetic peptide
  Seed: SFVYVWKTWGQYWQVLGGPVSGLSI (PMEL_HUMAN)
  Core: WQVLGGPVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQYXQVXGXPVXGLSI

SEQ ID NO: 336524 - protein, 25 aa, Artificial Sequence
  Description of Artificial Sequence: Synthetic peptide
  Seed: SFVYVWKTWGQYWQVLGGPVSGLSI (PMEL_HUMAN)
  Core: VLGGPVSGL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SFVYVWKTWGQYWQXLGXPXSGXSI

SEQ ID NO: 336525 - protein, 20 aa, Artificial Sequence
  Description of Artificial Sequence: Synthetic peptide
  Seed: SGEGDAFELTVSCQGGLPKE (PMEL_HUMAN)
  Core: FELTVSCQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGEGDAXELXVXCQXGLPKE

SEQ ID NO: 336526 - protein, 23 aa, Artificial Sequence
  Description of Artificial Sequence: Synthetic peptide
  Seed: SGEGDAFELTVSCQGGLPKEACM (PMEL_HUMAN)
  Core: CQGGLPKEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGEGDAFELTVSXQGXLXKEXCM

SEQ ID NO: 336527 - protein, 24 aa, Artificial Sequence
  Description of Artificial Sequence: Synthetic peptide
  Seed: SGEGDAFELTVSCQGGLPKEACME (PMEL_HUMAN)
  Core: CQGGLPKEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGEGDAFELTVSXQGXLXKEXCME

SEQ ID NO: 336528 - protein, 25 aa, Artificial Sequence
  Description of Artificial Sequence: Synthetic peptide
  Seed: SGEGDAFELTVSCQGGLPKEACMEI (PMEL_HUMAN)
  Core: CQGGLPKEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGEGDAFELTVSXQGXLXKEXCMEI

SEQ ID NO: 336529 - protein, 13 aa, Artificial Sequence
  Description of Artificial Sequence: Synthetic peptide
  Seed: SGLSIGTGRAMLG (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLX

SEQ ID NO: 336530 - protein, 14 aa, Artificial Sequence
  Description of Artificial Sequence: Synthetic peptide
  Seed: SGLSIGTGRAMLGT (PMEL_HUMAN)
  Core: LSIGTGRAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXSIXTXRAXLGT

SEQ ID NO: 336531 - protein, 14 aa, Artificial Sequence
  Description of Artificial Sequence: Synthetic peptide
  Seed: SGLSIGTGRAMLGT (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXT

SEQ ID NO: 336532 - protein, 15 aa, Artificial Sequence
  Description of Artificial Sequence: Synthetic peptide
  Seed: SGLSIGTGRAMLGTH (PMEL_HUMAN)
  Core: LSIGTGRAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXSIXTXRAXLGTH

SEQ ID NO: 336533 - protein, 15 aa, Artificial Sequence
  Description of Artificial Sequence: Synthetic peptide
  Seed: SGLSIGTGRAMLGTH (PMEL_HUMAN)
  Core: SIGTGRAML
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGLXIGXGXAMXGTH

SEQ ID NO: 336534 - protein, 15 aa, Artificial Sequence
  Description of Artificial Sequence: Synthetic peptide
  Seed: SGLSIGTGRAMLGTH (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTH

SEQ ID NO: 336535 - protein, 16 aa, Artificial Sequence
  Description of Artificial Sequence: Synthetic peptide
  Seed: SGLSIGTGRAMLGTHT (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHT

SEQ ID NO: 336536 - protein, 17 aa, Artificial Sequence
  Description of Artificial Sequence: Synthetic peptide
  Seed: SGLSIGTGRAMLGTHTM (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHTM

SEQ ID NO: 336537 - protein, 18 aa, Artificial Sequence
  Description of Artificial Sequence: Synthetic peptide
  Seed: SGLSIGTGRAMLGTHTME (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHTME

SEQ ID NO: 336538 - protein, 19 aa, Artificial Sequence
  Description of Artificial Sequence: Synthetic peptide
  Seed: SGLSIGTGRAMLGTHTMEV (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHTMEV

SEQ ID NO: 336539 - protein, 19 aa, Artificial Sequence
  Description of Artificial Sequence: Synthetic peptide
  Seed: SGLSIGTGRAMLGTHTMEV (PMEL_HUMAN)
  Core: MLGTHTMEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAXLGXHXMEX

SEQ ID NO: 336540 - protein, 20 aa, Artificial Sequence
  Description of Artificial Sequence: Synthetic peptide
  Seed: SGLSIGTGRAMLGTHTMEVT (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHTMEVT

SEQ ID NO: 336541 - protein, 20 aa, Artificial Sequence
  Description of Artificial Sequence: Synthetic peptide
  Seed: SGLSIGTGRAMLGTHTMEVT (PMEL_HUMAN)
  Core: RAMLGTHTM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGXAMXGXHTXEVT

SEQ ID NO: 336542 - protein, 20 aa, Artificial Sequence
  Description of Artificial Sequence: Synthetic peptide
  Seed: SGLSIGTGRAMLGTHTMEVT (PMEL_HUMAN)
  Core: MLGTHTMEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAXLGXHXMEXT

SEQ ID NO: 336543 - protein, 21 aa, Artificial Sequence
  Description of Artificial Sequence: Synthetic peptide
  Seed: SGLSIGTGRAMLGTHTMEVTV (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHTMEVTV

SEQ ID NO: 336544 - protein, 21 aa, Artificial Sequence
  Description of Artificial Sequence: Synthetic peptide
  Seed: SGLSIGTGRAMLGTHTMEVTV (PMEL_HUMAN)
  Core: RAMLGTHTM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGXAMXGXHTXEVTV

SEQ ID NO: 336545 - protein, 21 aa, Artificial Sequence
  Description of Artificial Sequence: Synthetic peptide
  Seed: SGLSIGTGRAMLGTHTMEVTV (PMEL_HUMAN)
  Core: MLGTHTMEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAXLGXHXMEXTV

SEQ ID NO: 336546 - protein, 22 aa, Artificial Sequence
  Description of Artificial Sequence: Synthetic peptide
  Seed: SGLSIGTGRAMLGTHTMEVTVY (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHTMEVTVY

SEQ ID NO: 336547 - protein, 22 aa, Artificial Sequence
  Description of Artificial Sequence: Synthetic peptide
  Seed: SGLSIGTGRAMLGTHTMEVTVY (PMEL_HUMAN)
  Core: RAMLGTHTM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGXAMXGXHTXEVTVY

SEQ ID NO: 336548 - protein, 22 aa, Artificial Sequence
  Description of Artificial Sequence: Synthetic peptide
  Seed: SGLSIGTGRAMLGTHTMEVTVY (PMEL_HUMAN)
  Core: MLGTHTMEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAXLGXHXMEXTVY

SEQ ID NO: 336549 - protein, 23 aa, Artificial Sequence
  Description of Artificial Sequence: Synthetic peptide
  Seed: SGLSIGTGRAMLGTHTMEVTVYH (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHTMEVTVYH

SEQ ID NO: 336550 - protein, 23 aa, Artificial Sequence
  Description of Artificial Sequence: Synthetic peptide
  Seed: SGLSIGTGRAMLGTHTMEVTVYH (PMEL_HUMAN)
  Core: RAMLGTHTM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGXAMXGXHTXEVTVYH

SEQ ID NO: 336551 - protein, 23 aa, Artificial Sequence
  Description of Artificial Sequence: Synthetic peptide
  Seed: SGLSIGTGRAMLGTHTMEVTVYH (PMEL_HUMAN)
  Core: MLGTHTMEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAXLGXHXMEXTVYH

SEQ ID NO: 336552 - protein, 23 aa, Artificial Sequence
  Description of Artificial Sequence: Synthetic peptide
  Seed: SGLSIGTGRAMLGTHTMEVTVYH (PMEL_HUMAN)
  Core: LGTHTMEVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAMXGTXTXEVXVYH

SEQ ID NO: 336553 - protein, 24 aa, Artificial Sequence
  Description of Artificial Sequence: Synthetic peptide
  Seed: SGLSIGTGRAMLGTHTMEVTVYHR (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHTMEVTVYHR

SEQ ID NO: 336554 - protein, 24 aa, Artificial Sequence
  Description of Artificial Sequence: Synthetic peptide
  Seed: SGLSIGTGRAMLGTHTMEVTVYHR (PMEL_HUMAN)
  Core: RAMLGTHTM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGXAMXGXHTXEVTVYHR

SEQ ID NO: 336555 - protein, 24 aa, Artificial Sequence
  Description of Artificial Sequence: Synthetic peptide
  Seed: SGLSIGTGRAMLGTHTMEVTVYHR (PMEL_HUMAN)
  Core: MLGTHTMEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAXLGXHXMEXTVYHR

SEQ ID NO: 336556 - protein, 24 aa, Artificial Sequence
  Description of Artificial Sequence: Synthetic peptide
  Seed: SGLSIGTGRAMLGTHTMEVTVYHR (PMEL_HUMAN)
  Core: LGTHTMEVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAMXGTXTXEVXVYHR

SEQ ID NO: 336557 - protein, 25 aa, Artificial Sequence
  Description of Artificial Sequence: Synthetic peptide
  Seed: SGLSIGTGRAMLGTHTMEVTVYHRR (PMEL_HUMAN)
  Core: IGTGRAMLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGLSXGTXRXMLXTHTMEVTVYHRR

SEQ ID NO: 336558 - protein, 25 aa, Artificial Sequence
  Description of Artificial Sequence: Synthetic peptide
  Seed: SGLSIGTGRAMLGTHTMEVTVYHRR (PMEL_HUMAN)
  Core: RAMLGTHTM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGXAMXGXHTXEVTVYHRR

SEQ ID NO: 336559 - protein, 25 aa, Artificial Sequence
  Description of Artificial Sequence: Synthetic peptide
  Seed: SGLSIGTGRAMLGTHTMEVTVYHRR (PMEL_HUMAN)
  Core: MLGTHTMEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAXLGXHXMEXTVYHRR

SEQ ID NO: 336560 - protein, 25 aa, Artificial Sequence
  Description of Artificial Sequence: Synthetic peptide
  Seed: SGLSIGTGRAMLGTHTMEVTVYHRR (PMEL_HUMAN)
  Core: LGTHTMEVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAMXGTXTXEVXVYHRR

SEQ ID NO: 336561 - protein, 25 aa, Artificial Sequence
  Description of Artificial Sequence: Synthetic peptide
  Seed: SGLSIGTGRAMLGTHTMEVTVYHRR (PMEL_HUMAN)
  Core: THTMEVTVY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAMLGXHTXEXTVXHRR

SEQ ID NO: 336562 - protein, 25 aa, Artificial Sequence
  Description of Artificial Sequence: Synthetic peptide
  Seed: SGLSIGTGRAMLGTHTMEVTVYHRR (PMEL_HUMAN)
  Core: MEVTVYHRR
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
SGLSIGTGRAMLGTHTXEVXVXHRX

SEQ ID NO: 336563 - protein, 15 aa, Artificial Sequence
  Description of Artificial Sequence: Synthetic peptide
  Seed: SGSWSQKRSFVYVWK (PMEL_HUMAN)
  Core: WSQKRSFVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGSXSQXRXFVXVWK

SEQ ID NO: 336564 - protein, 16 aa, Artificial Sequence
  Description of Artificial Sequence: Synthetic peptide
  Seed: SGSWSQKRSFVYVWKT (PMEL_HUMAN)
  Core: WSQKRSFVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGSXSQXRXFVXVWKT

SEQ ID NO: 336565 - protein, 16 aa, Artificial Sequence
  Description of Artificial Sequence: Synthetic peptide
  Seed: SGSWSQKRSFVYVWKT (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKX

SEQ ID NO: 336566 - protein, 17 aa, Artificial Sequence
  Description of Artificial Sequence: Synthetic peptide
  Seed: SGSWSQKRSFVYVWKTW (PMEL_HUMAN)
  Core: WSQKRSFVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGSXSQXRXFVXVWKTW

SEQ ID NO: 336567 - protein, 17 aa, Artificial Sequence
  Description of Artificial Sequence: Synthetic peptide
  Seed: SGSWSQKRSFVYVWKTW (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKXW

SEQ ID NO: 336568 - protein, 18 aa, Artificial Sequence
  Description of Artificial Sequence: Synthetic peptide
  Seed: SGSWSQKRSFVYVWKTWG (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKXWG

SEQ ID NO: 336569 - protein, 19 aa, Artificial Sequence
  Description of Artificial Sequence: Synthetic peptide
  Seed: SGSWSQKRSFVYVWKTWGQ (PMEL_HUMAN)
  Core: WSQKRSFVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGSXSQXRXFVXVWKTWGQ

SEQ ID NO: 336570 - protein, 19 aa, Artificial Sequence
  Description of Artificial Sequence: Synthetic peptide
  Seed: SGSWSQKRSFVYVWKTWGQ (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKXWGQ

SEQ ID NO: 336571 - protein, 19 aa, Artificial Sequence
  Description of Artificial Sequence: Synthetic peptide
  Seed: SGSWSQKRSFVYVWKTWGQ (PMEL_HUMAN)
  Core: FVYVWKTWG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSXVYXWXTWXQ

SEQ ID NO: 336572 - protein, 19 aa, Artificial Sequence
  Description of Artificial Sequence: Synthetic peptide
  Seed: SGSWSQKRSFVYVWKTWGQ (PMEL_HUMAN)
  Core: VYVWKTWGQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFXYVXKXWGX

SEQ ID NO: 336573 - protein, 20 aa, Artificial Sequence
  Description of Artificial Sequence: Synthetic peptide
  Seed: SGSWSQKRSFVYVWKTWGQY (PMEL_HUMAN)
  Core: WSQKRSFVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGSXSQXRXFVXVWKTWGQY

SEQ ID NO: 336574 - protein, 20 aa, Artificial Sequence
  Description of Artificial Sequence: Synthetic peptide
  Seed: SGSWSQKRSFVYVWKTWGQY (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKXWGQY

SEQ ID NO: 336575 - protein, 20 aa, Artificial Sequence
  Description of Artificial Sequence: Synthetic peptide
  Seed: SGSWSQKRSFVYVWKTWGQY (PMEL_HUMAN)
  Core: FVYVWKTWG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSXVYXWXTWXQY

SEQ ID NO: 336576 - protein, 20 aa, Artificial Sequence
  Description of Artificial Sequence: Synthetic peptide
  Seed: SGSWSQKRSFVYVWKTWGQY (PMEL_HUMAN)
  Core: VYVWKTWGQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFXYVXKXWGXY

SEQ ID NO: 336577 - protein, 20 aa, Artificial Sequence
  Description of Artificial Sequence: Synthetic peptide
  Seed: SGSWSQKRSFVYVWKTWGQY (PMEL_HUMAN)
  Core: YVWKTWGQY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFVXVWXTXGQX

SEQ ID NO: 336578 - protein, 21 aa, Artificial Sequence
  Description of Artificial Sequence: Synthetic peptide
  Seed: SGSWSQKRSFVYVWKTWGQYW (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKXWGQYW

SEQ ID NO: 336579 - protein, 21 aa, Artificial Sequence
  Description of Artificial Sequence: Synthetic peptide
  Seed: SGSWSQKRSFVYVWKTWGQYW (PMEL_HUMAN)
  Core: FVYVWKTWG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSXVYXWXTWXQYW

SEQ ID NO: 336580 - protein, 21 aa, Artificial Sequence
  Description of Artificial Sequence: Synthetic peptide
  Seed: SGSWSQKRSFVYVWKTWGQYW (PMEL_HUMAN)
  Core: VYVWKTWGQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFXYVXKXWGXYW

SEQ ID NO: 336581 - protein, 21 aa, Artificial Sequence
  Description of Artificial Sequence: Synthetic peptide
  Seed: SGSWSQKRSFVYVWKTWGQYW (PMEL_HUMAN)
  Core: YVWKTWGQY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFVXVWXTXGQXW

SEQ ID NO: 336582 - protein, 22 aa, Artificial Sequence
  Description of Artificial Sequence: Synthetic peptide
  Seed: SGSWSQKRSFVYVWKTWGQYWQ (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKXWGQYWQ

SEQ ID NO: 336583 - protein, 22 aa, Artificial Sequence
  Description of Artificial Sequence: Synthetic peptide
  Seed: SGSWSQKRSFVYVWKTWGQYWQ (PMEL_HUMAN)
  Core: FVYVWKTWG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSXVYXWXTWXQYWQ

SEQ ID NO: 336584 - protein, 22 aa, Artificial Sequence
  Description of Artificial Sequence: Synthetic peptide
  Seed: SGSWSQKRSFVYVWKTWGQYWQ (PMEL_HUMAN)
  Core: VYVWKTWGQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFXYVXKXWGXYWQ

SEQ ID NO: 336585 - protein, 22 aa, Artificial Sequence
  Description of Artificial Sequence: Synthetic peptide
  Seed: SGSWSQKRSFVYVWKTWGQYWQ (PMEL_HUMAN)
  Core: YVWKTWGQY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFVXVWXTXGQXWQ

SEQ ID NO: 336586 - protein, 23 aa, Artificial Sequence
  Description of Artificial Sequence: Synthetic peptide
  Seed: SGSWSQKRSFVYVWKTWGQYWQV (PMEL_HUMAN)
  Core: WSQKRSFVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGSXSQXRXFVXVWKTWGQYWQV

SEQ ID NO: 336587 - protein, 23 aa, Artificial Sequence
  Description of Artificial Sequence: Synthetic peptide
  Seed: SGSWSQKRSFVYVWKTWGQYWQV (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKXWGQYWQV

SEQ ID NO: 336588 - protein, 23 aa, Artificial Sequence
  Description of Artificial Sequence: Synthetic peptide
  Seed: SGSWSQKRSFVYVWKTWGQYWQV (PMEL_HUMAN)
  Core: FVYVWKTWG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSXVYXWXTWXQYWQV

SEQ ID NO: 336589 - protein, 23 aa, Artificial Sequence
  Description of Artificial Sequence: Synthetic peptide
  Seed: SGSWSQKRSFVYVWKTWGQYWQV (PMEL_HUMAN)
  Core: VYVWKTWGQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFXYVXKXWGXYWQV

SEQ ID NO: 336590 - protein, 23 aa, Artificial Sequence
  Description of Artificial Sequence: Synthetic peptide
  Seed: SGSWSQKRSFVYVWKTWGQYWQV (PMEL_HUMAN)
  Core: YVWKTWGQY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFVXVWXTXGQXWQV

SEQ ID NO: 336591 - protein, 24 aa, Artificial Sequence
  Description of Artificial Sequence: Synthetic peptide
  Seed: SGSWSQKRSFVYVWKTWGQYWQVL (PMEL_HUMAN)
  Core: WSQKRSFVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGSXSQXRXFVXVWKTWGQYWQVL

SEQ ID NO: 336592 - protein, 24 aa, Artificial Sequence
  Description of Artificial Sequence: Synthetic peptide
  Seed: SGSWSQKRSFVYVWKTWGQYWQVL (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKXWGQYWQVL

SEQ ID NO: 336593 - protein, 24 aa, Artificial Sequence
  Description of Artificial Sequence: Synthetic peptide
  Seed: SGSWSQKRSFVYVWKTWGQYWQVL (PMEL_HUMAN)
  Core: FVYVWKTWG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSXVYXWXTWXQYWQVL

SEQ ID NO: 336594 - protein, 24 aa, Artificial Sequence
  Description of Artificial Sequence: Synthetic peptide
  Seed: SGSWSQKRSFVYVWKTWGQYWQVL (PMEL_HUMAN)
  Core: VYVWKTWGQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFXYVXKXWGXYWQVL

SEQ ID NO: 336595 - protein, 24 aa, Artificial Sequence
  Description of Artificial Sequence: Synthetic peptide
  Seed: SGSWSQKRSFVYVWKTWGQYWQVL (PMEL_HUMAN)
  Core: YVWKTWGQY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFVXVWXTXGQXWQVL

SEQ ID NO: 336596 - protein, 25 aa, Artificial Sequence
  Description of Artificial Sequence: Synthetic peptide
  Seed: SGSWSQKRSFVYVWKTWGQYWQVLG (PMEL_HUMAN)
  Core: WSQKRSFVY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGSXSQXRXFVXVWKTWGQYWQVLG

SEQ ID NO: 336597 - protein, 25 aa, Artificial Sequence
  Description of Artificial Sequence: Synthetic peptide
  Seed: SGSWSQKRSFVYVWKTWGQYWQVLG (PMEL_HUMAN)
  Core: RSFVYVWKT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKXSFXYXWKXWGQYWQVLG

SEQ ID NO: 336598 - protein, 25 aa, Artificial Sequence
  Description of Artificial Sequence: Synthetic peptide
  Seed: SGSWSQKRSFVYVWKTWGQYWQVLG (PMEL_HUMAN)
  Core: FVYVWKTWG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSXVYXWXTWXQYWQVLG

SEQ ID NO: 336599 - protein, 25 aa, Artificial Sequence
  Description of Artificial Sequence: Synthetic peptide
  Seed: SGSWSQKRSFVYVWKTWGQYWQVLG (PMEL_HUMAN)
  Core: VYVWKTWGQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFXYVXKXWGXYWQVLG

SEQ ID NO: 336600 - protein, 25 aa, Artificial Sequence
  Description of Artificial Sequence: Synthetic peptide
  Seed: SGSWSQKRSFVYVWKTWGQYWQVLG (PMEL_HUMAN)
  Core: YVWKTWGQY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGSWSQKRSFVXVWXTXGQXWQVLG

SEQ ID NO: 336601 - protein, 13 aa, Artificial Sequence
  Description of Artificial Sequence: Synthetic peptide
  Seed: SGTLISRALVVTH (PMEL_HUMAN)
  Core: TLISRALVV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLIXRXLVXTH

SEQ ID NO: 336602 - protein, 13 aa, Artificial Sequence
  Description of Artificial Sequence: Synthetic peptide
  Seed: SGTLISRALVVTH (PMEL_HUMAN)
  Core: ISRALVVTH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGTLXSRXLXVTX

SEQ ID NO: 336603 - protein, 14 aa, Artificial Sequence
  Description of Artificial Sequence: Synthetic peptide
  Seed: SGTLISRALVVTHT (PMEL_HUMAN)
  Core: TLISRALVV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLIXRXLVXTHT

SEQ ID NO: 336604 - protein, 14 aa, Artificial Sequence
  Description of Artificial Sequence: Synthetic peptide
  Seed: SGTLISRALVVTHT (PMEL_HUMAN)
  Core: LISRALVVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXISXAXVVXHT

SEQ ID NO: 336605 - protein, 14 aa, Artificial Sequence
  Description of Artificial Sequence: Synthetic peptide
  Seed: SGTLISRALVVTHT (PMEL_HUMAN)
  Core: ISRALVVTH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGTLXSRXLXVTXT

SEQ ID NO: 336606 - protein, 15 aa, Artificial Sequence
  Description of Artificial Sequence: Synthetic peptide
  Seed: SGTLISRALVVTHTY (PMEL_HUMAN)
  Core: TLISRALVV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLIXRXLVXTHTY

SEQ ID NO: 336607 - protein, 15 aa, Artificial Sequence
  Description of Artificial Sequence: Synthetic peptide
  Seed: SGTLISRALVVTHTY (PMEL_HUMAN)
  Core: LISRALVVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXISXAXVVXHTY

SEQ ID NO: 336608 - protein, 15 aa, Artificial Sequence
  Description of Artificial Sequence: Synthetic peptide
  Seed: SGTLISRALVVTHTY (PMEL_HUMAN)
  Core: ISRALVVTH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGTLXSRXLXVTXTY

SEQ ID NO: 336609 - protein, 15 aa, Artificial Sequence
  Description of Artificial Sequence: Synthetic peptide
  Seed: SGTLISRALVVTHTY (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXY

SEQ ID NO: 336610 - protein, 15 aa, Artificial Sequence
  Description of Artificial Sequence: Synthetic peptide
  Seed: SGTLISRALVVTHTY (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTX

SEQ ID NO: 336611 - protein, 16 aa, Artificial Sequence
  Description of Artificial Sequence: Synthetic peptide
  Seed: SGTLISRALVVTHTYL (PMEL_HUMAN)
  Core: TLISRALVV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLIXRXLVXTHTYL

SEQ ID NO: 336612 - protein, 16 aa, Artificial Sequence
  Description of Artificial Sequence: Synthetic peptide
  Seed: SGTLISRALVVTHTYL (PMEL_HUMAN)
  Core: LISRALVVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXISXAXVVXHTYL

SEQ ID NO: 336613 - protein, 16 aa, Artificial Sequence
  Description of Artificial Sequence: Synthetic peptide
  Seed: SGTLISRALVVTHTYL (PMEL_HUMAN)
  Core: ISRALVVTH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGTLXSRXLXVTXTYL

SEQ ID NO: 336614 - protein, 16 aa, Artificial Sequence
  Description of Artificial Sequence: Synthetic peptide
  Seed: SGTLISRALVVTHTYL (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXYL

SEQ ID NO: 336615 - protein, 16 aa, Artificial Sequence
  Description of Artificial Sequence: Synthetic peptide
  Seed: SGTLISRALVVTHTYL (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXL

SEQ ID NO: 336616 - protein, 17 aa, Artificial Sequence
  Description of Artificial Sequence: Synthetic peptide
  Seed: SGTLISRALVVTHTYLE (PMEL_HUMAN)
  Core: TLISRALVV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLIXRXLVXTHTYLE

SEQ ID NO: 336617 - protein, 17 aa, Artificial Sequence
  Description of Artificial Sequence: Synthetic peptide
  Seed: SGTLISRALVVTHTYLE (PMEL_HUMAN)
  Core: LISRALVVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXISXAXVVXHTYLE

SEQ ID NO: 336618 - protein, 17 aa, Artificial Sequence
  Description of Artificial Sequence: Synthetic peptide
  Seed: SGTLISRALVVTHTYLE (PMEL_HUMAN)
  Core: ISRALVVTH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGTLXSRXLXVTXTYLE

SEQ ID NO: 336619 - protein, 17 aa, Artificial Sequence
  Description of Artificial Sequence: Synthetic peptide
  Seed: SGTLISRALVVTHTYLE (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXYLE

SEQ ID NO: 336620 - protein, 17 aa, Artificial Sequence
  Description of Artificial Sequence: Synthetic peptide
  Seed: SGTLISRALVVTHTYLE (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXLE

SEQ ID NO: 336621 - protein, 17 aa, Artificial Sequence
  Description of Artificial Sequence: Synthetic peptide
  Seed: SGTLISRALVVTHTYLE (PMEL_HUMAN)
  Core: LVVTHTYLE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRAXVVXHXYLX

SEQ ID NO: 336622 - protein, 18 aa, Artificial Sequence
  Description of Artificial Sequence: Synthetic peptide
  Seed: SGTLISRALVVTHTYLEP (PMEL_HUMAN)
  Core: LISRALVVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXISXAXVVXHTYLEP

SEQ ID NO: 336623 - protein, 18 aa, Artificial Sequence
  Description of Artificial Sequence: Synthetic peptide
  Seed: SGTLISRALVVTHTYLEP (PMEL_HUMAN)
  Core: ISRALVVTH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGTLXSRXLXVTXTYLEP

SEQ ID NO: 336624 - protein, 18 aa, Artificial Sequence
  Description of Artificial Sequence: Synthetic peptide
  Seed: SGTLISRALVVTHTYLEP (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXLEP

SEQ ID NO: 336625 - protein, 18 aa, Artificial Sequence
  Description of Artificial Sequence: Synthetic peptide
  Seed: SGTLISRALVVTHTYLEP (PMEL_HUMAN)
  Core: LVVTHTYLE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRAXVVXHXYLXP

SEQ ID NO: 336626 - protein, 19 aa, Artificial Sequence
  Description of Artificial Sequence: Synthetic peptide
  Seed: SGTLISRALVVTHTYLEPG (PMEL_HUMAN)
  Core: ISRALVVTH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGTLXSRXLXVTXTYLEPG

SEQ ID NO: 336627 - protein, 19 aa, Artificial Sequence
  Description of Artificial Sequence: Synthetic peptide
  Seed: SGTLISRALVVTHTYLEPG (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXYLEPG

SEQ ID NO: 336628 - protein, 19 aa, Artificial Sequence
  Description of Artificial Sequence: Synthetic peptide
  Seed: SGTLISRALVVTHTYLEPG (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXLEPG

SEQ ID NO: 336629 - protein, 19 aa, Artificial Sequence
  Description of Artificial Sequence: Synthetic peptide
  Seed: SGTLISRALVVTHTYLEPG (PMEL_HUMAN)
  Core: LVVTHTYLE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRAXVVXHXYLXPG

SEQ ID NO: 336630 - protein, 19 aa, Artificial Sequence
  Description of Artificial Sequence: Synthetic peptide
  Seed: SGTLISRALVVTHTYLEPG (PMEL_HUMAN)
  Core: VVTHTYLEP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALXVTXTXLEXG

SEQ ID NO: 336631 - protein, 19 aa, Artificial Sequence
  Description of Artificial Sequence: Synthetic peptide
  Seed: SGTLISRALVVTHTYLEPG (PMEL_HUMAN)
  Core: VTHTYLEPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALVXTHXYXEPX

SEQ ID NO: 336632 - protein, 20 aa, Artificial Sequence
  Description of Artificial Sequence: Synthetic peptide
  Seed: SGTLISRALVVTHTYLEPGP (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXYLEPGP

SEQ ID NO: 336633 - protein, 20 aa, Artificial Sequence
  Description of Artificial Sequence: Synthetic peptide
  Seed: SGTLISRALVVTHTYLEPGP (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXLEPGP

SEQ ID NO: 336634 - protein, 20 aa, Artificial Sequence
  Description of Artificial Sequence: Synthetic peptide
  Seed: SGTLISRALVVTHTYLEPGP (PMEL_HUMAN)
  Core: LVVTHTYLE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRAXVVXHXYLXPGP

SEQ ID NO: 336635 - protein, 20 aa, Artificial Sequence
  Description of Artificial Sequence: Synthetic peptide
  Seed: SGTLISRALVVTHTYLEPGP (PMEL_HUMAN)
  Core: VVTHTYLEP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALXVTXTXLEXGP

SEQ ID NO: 336636 - protein, 20 aa, Artificial Sequence
  Description of Artificial Sequence: Synthetic peptide
  Seed: SGTLISRALVVTHTYLEPGP (PMEL_HUMAN)
  Core: VTHTYLEPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALVXTHXYXEPXP

SEQ ID NO: 336637 - protein, 21 aa, Artificial Sequence
  Description of Artificial Sequence: Synthetic peptide
  Seed: SGTLISRALVVTHTYLEPGPV (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXYLEPGPV

SEQ ID NO: 336638 - protein, 21 aa, Artificial Sequence
  Description of Artificial Sequence: Synthetic peptide
  Seed: SGTLISRALVVTHTYLEPGPV (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXLEPGPV

SEQ ID NO: 336639 - protein, 21 aa, Artificial Sequence
  Description of Artificial Sequence: Synthetic peptide
  Seed: SGTLISRALVVTHTYLEPGPV (PMEL_HUMAN)
  Core: LVVTHTYLE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRAXVVXHXYLXPGPV

SEQ ID NO: 336640 - protein, 21 aa, Artificial Sequence
  Description of Artificial Sequence: Synthetic peptide
  Seed: SGTLISRALVVTHTYLEPGPV (PMEL_HUMAN)
  Core: VVTHTYLEP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALXVTXTXLEXGPV

SEQ ID NO: 336641 - protein, 21 aa, Artificial Sequence
  Description of Artificial Sequence: Synthetic peptide
  Seed: SGTLISRALVVTHTYLEPGPV (PMEL_HUMAN)
  Core: VTHTYLEPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALVXTHXYXEPXPV

SEQ ID NO: 336642 - protein, 22 aa, Artificial Sequence
  Description of Artificial Sequence: Synthetic peptide
  Seed: SGTLISRALVVTHTYLEPGPVT (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXYLEPGPVT

SEQ ID NO: 336643 - protein, 22 aa, Artificial Sequence
  Description of Artificial Sequence: Synthetic peptide
  Seed: SGTLISRALVVTHTYLEPGPVT (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXLEPGPVT

SEQ ID NO: 336644 - protein, 22 aa, Artificial Sequence
  Description of Artificial Sequence: Synthetic peptide
  Seed: SGTLISRALVVTHTYLEPGPVT (PMEL_HUMAN)
  Core: LVVTHTYLE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRAXVVXHXYLXPGPVT

SEQ ID NO: 336645 - protein, 22 aa, Artificial Sequence
  Description of Artificial Sequence: Synthetic peptide
  Seed: SGTLISRALVVTHTYLEPGPVT (PMEL_HUMAN)
  Core: VVTHTYLEP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALXVTXTXLEXGPVT

SEQ ID NO: 336646 - protein, 22 aa, Artificial Sequence
  Description of Artificial Sequence: Synthetic peptide
  Seed: SGTLISRALVVTHTYLEPGPVT (PMEL_HUMAN)
  Core: VTHTYLEPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALVXTHXYXEPXPVT

SEQ ID NO: 336647 - protein, 23 aa, Artificial Sequence
  Description of Artificial Sequence: Synthetic peptide
  Seed: SGTLISRALVVTHTYLEPGPVTA (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXYLEPGPVTA

SEQ ID NO: 336648 - protein, 23 aa, Artificial Sequence
  Description of Artificial Sequence: Synthetic peptide
  Seed: SGTLISRALVVTHTYLEPGPVTA (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXLEPGPVTA

SEQ ID NO: 336649 - protein, 23 aa, Artificial Sequence
  Description of Artificial Sequence: Synthetic peptide
  Seed: SGTLISRALVVTHTYLEPGPVTA (PMEL_HUMAN)
  Core: LVVTHTYLE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRAXVVXHXYLXPGPVTA

SEQ ID NO: 336650 - protein, 23 aa, Artificial Sequence
  Description of Artificial Sequence: Synthetic peptide
  Seed: SGTLISRALVVTHTYLEPGPVTA (PMEL_HUMAN)
  Core: VVTHTYLEP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALXVTXTXLEXGPVTA

SEQ ID NO: 336651 - protein, 23 aa, Artificial Sequence
  Description of Artificial Sequence: Synthetic peptide
  Seed: SGTLISRALVVTHTYLEPGPVTA (PMEL_HUMAN)
  Core: VTHTYLEPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALVXTHXYXEPXPVTA

SEQ ID NO: 336652 - protein, 24 aa, Artificial Sequence
  Description of Artificial Sequence: Synthetic peptide
  Seed: SGTLISRALVVTHTYLEPGPVTAQ (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXYLEPGPVTAQ

SEQ ID NO: 336653 - protein, 24 aa, Artificial Sequence
  Description of Artificial Sequence: Synthetic peptide
  Seed: SGTLISRALVVTHTYLEPGPVTAQ (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXLEPGPVTAQ

SEQ ID NO: 336654 - protein, 24 aa, Artificial Sequence
  Description of Artificial Sequence: Synthetic peptide
  Seed: SGTLISRALVVTHTYLEPGPVTAQ (PMEL_HUMAN)
  Core: LVVTHTYLE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRAXVVXHXYLXPGPVTAQ

SEQ ID NO: 336655 - protein, 24 aa, Artificial Sequence
  Description of Artificial Sequence: Synthetic peptide
  Seed: SGTLISRALVVTHTYLEPGPVTAQ (PMEL_HUMAN)
  Core: VVTHTYLEP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALXVTXTXLEXGPVTAQ

SEQ ID NO: 336656 - protein, 24 aa, Artificial Sequence
  Description of Artificial Sequence: Synthetic peptide
  Seed: SGTLISRALVVTHTYLEPGPVTAQ (PMEL_HUMAN)
  Core: VTHTYLEPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALVXTHXYXEPXPVTAQ

SEQ ID NO: 336657 - protein, 24 aa, Artificial Sequence
  Description of Artificial Sequence: Synthetic peptide
  Seed: SGTLISRALVVTHTYLEPGPVTAQ (PMEL_HUMAN)
  Core: HTYLEPGPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALVVTXTYXEXGPXTAQ

SEQ ID NO: 336658 - protein, 25 aa, Artificial Sequence
  Description of Artificial Sequence: Synthetic peptide
  Seed: SGTLISRALVVTHTYLEPGPVTAQV (PMEL_HUMAN)
  Core: SRALVVTHT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTLIXRAXVXTHXYLEPGPVTAQV

SEQ ID NO: 336659 - protein, 25 aa, Artificial Sequence
  Description of Artificial Sequence: Synthetic peptide
  Seed: SGTLISRALVVTHTYLEPGPVTAQV (PMEL_HUMAN)
  Core: RALVVTHTY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISXALXVXHTXLEPGPVTAQV

SEQ ID NO: 336660 - protein, 25 aa, Artificial Sequence
  Description of Artificial Sequence: Synthetic peptide
  Seed: SGTLISRALVVTHTYLEPGPVTAQV (PMEL_HUMAN)
  Core: LVVTHTYLE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRAXVVXHXYLXPGPVTAQV

SEQ ID NO: 336661 - protein, 25 aa, Artificial Sequence
  Description of Artificial Sequence: Synthetic peptide
  Seed: SGTLISRALVVTHTYLEPGPVTAQV (PMEL_HUMAN)
  Core: VVTHTYLEP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALXVTXTXLEXGPVTAQV

SEQ ID NO: 336662 - protein, 25 aa, Artificial Sequence
  Description of Artificial Sequence: Synthetic peptide
  Seed: SGTLISRALVVTHTYLEPGPVTAQV (PMEL_HUMAN)
  Core: VTHTYLEPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALVXTHXYXEPXPVTAQV

SEQ ID NO: 336663 - protein, 25 aa, Artificial Sequence
  Description of Artificial Sequence: Synthetic peptide
  Seed: SGTLISRALVVTHTYLEPGPVTAQV (PMEL_HUMAN)
  Core: HTYLEPGPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTLISRALVVTXTYXEXGPXTAQV

SEQ ID NO: 336664 - protein, 13 aa, Artificial Sequence
  Description of Artificial Sequence: Synthetic peptide
  Seed: SGTTAAQVTTTEW (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEW

SEQ ID NO: 336665 - protein, 14 aa, Artificial Sequence
  Description of Artificial Sequence: Synthetic peptide
  Seed: SGTTAAQVTTTEWV (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWV

SEQ ID NO: 336666 - protein, 15 aa, Artificial Sequence
  Description of Artificial Sequence: Synthetic peptide
  Seed: SGTTAAQVTTTEWVE (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWVE

SEQ ID NO: 336667 - protein, 16 aa, Artificial Sequence
  Description of Artificial Sequence: Synthetic peptide
  Seed: SGTTAAQVTTTEWVET (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWVET

SEQ ID NO: 336668 - protein, 17 aa, Artificial Sequence
  Description of Artificial Sequence: Synthetic peptide
  Seed: SGTTAAQVTTTEWVETT (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWVETT

SEQ ID NO: 336669 - protein, 18 aa, Artificial Sequence
  Description of Artificial Sequence: Synthetic peptide
  Seed: SGTTAAQVTTTEWVETTA (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWVETTA

SEQ ID NO: 336670 - protein, 19 aa, Artificial Sequence
  Description of Artificial Sequence: Synthetic peptide
  Seed: SGTTAAQVTTTEWVETTAR (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWVETTAR

SEQ ID NO: 336671 - protein, 19 aa, Artificial Sequence
  Description of Artificial Sequence: Synthetic peptide
  Seed: SGTTAAQVTTTEWVETTAR (PMEL_HUMAN)
  Core: VTTTEWVET
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQXTTXEXVEXTAR

SEQ ID NO: 336672 - protein, 20 aa, Artificial Sequence
  Description of Artificial Sequence: Synthetic peptide
  Seed: SGTTAAQVTTTEWVETTARE (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWVETTARE

SEQ ID NO: 336673 - protein, 20 aa, Artificial Sequence
  Description of Artificial Sequence: Synthetic peptide
  Seed: SGTTAAQVTTTEWVETTARE (PMEL_HUMAN)
  Core: VTTTEWVET
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQXTTXEXVEXTARE

SEQ ID NO: 336674 - protein, 20 aa, Artificial Sequence
  Description of Artificial Sequence: Synthetic peptide
  Seed: SGTTAAQVTTTEWVETTARE (PMEL_HUMAN)
  Core: TTTEWVETT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVXTTXWXETXARE

SEQ ID NO: 336675 - protein, 21 aa, Artificial Sequence
  Description of Artificial Sequence: Synthetic peptide
  Seed: SGTTAAQVTTTEWVETTAREL (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWVETTAREL

SEQ ID NO: 336676 - protein, 21 aa, Artificial Sequence
  Description of Artificial Sequence: Synthetic peptide
  Seed: SGTTAAQVTTTEWVETTAREL (PMEL_HUMAN)
  Core: VTTTEWVET
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQXTTXEXVEXTAREL

SEQ ID NO: 336677 - protein, 21 aa, Artificial Sequence
  Description of Artificial Sequence: Synthetic peptide
  Seed: SGTTAAQVTTTEWVETTAREL (PMEL_HUMAN)
  Core: TTTEWVETT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVXTTXWXETXAREL

SEQ ID NO: 336678 - protein, 21 aa, Artificial Sequence
  Description of Artificial Sequence: Synthetic peptide
  Seed: SGTTAAQVTTTEWVETTAREL (PMEL_HUMAN)
  Core: WVETTAREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVTTTEXVEXTXREX

SEQ ID NO: 336679 - protein, 22 aa, Artificial Sequence
  Description of Artificial Sequence: Synthetic peptide
  Seed: SGTTAAQVTTTEWVETTARELP (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWVETTARELP

SEQ ID NO: 336680 - protein, 22 aa, Artificial Sequence
  Description of Artificial Sequence: Synthetic peptide
  Seed: SGTTAAQVTTTEWVETTARELP (PMEL_HUMAN)
  Core: VTTTEWVET
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQXTTXEXVEXTARELP

SEQ ID NO: 336681 - protein, 22 aa, Artificial Sequence
  Description of Artificial Sequence: Synthetic peptide
  Seed: SGTTAAQVTTTEWVETTARELP (PMEL_HUMAN)
  Core: TTTEWVETT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVXTTXWXETXARELP

SEQ ID NO: 336682 - protein, 22 aa, Artificial Sequence
  Description of Artificial Sequence: Synthetic peptide
  Seed: SGTTAAQVTTTEWVETTARELP (PMEL_HUMAN)
  Core: WVETTAREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVTTTEXVEXTXREXP

SEQ ID NO: 336683 - protein, 23 aa, Artificial Sequence
  Description of Artificial Sequence: Synthetic peptide
  Seed: SGTTAAQVTTTEWVETTARELPI (PMEL_HUMAN)
  Core: TTAAQVTTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTAXQXTTXEWVETTARELPI

SEQ ID NO: 336684 - protein, 23 aa, Artificial Sequence
  Description of Artificial Sequence: Synthetic peptide
  Seed: SGTTAAQVTTTEWVETTARELPI (PMEL_HUMAN)
  Core: VTTTEWVET
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQXTTXEXVEXTARELPI

SEQ ID NO: 336685 - protein, 23 aa, Artificial Sequence
  Description of Artificial Sequence: Synthetic peptide
  Seed: SGTTAAQVTTTEWVETTARELPI (PMEL_HUMAN)
  Core: TTTEWVETT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVXTTXWXETXARELPI

SEQ ID NO: 336686 - protein, 23 aa, Artificial Sequence
  Description of Artificial Sequence: Synthetic peptide
  Seed: SGTTAAQVTTTEWVETTARELPI (PMEL_HUMAN)
  Core: WVETTAREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVTTTEXVEXTXREXPI

SEQ ID NO: 336687 - protein, 24 aa, Artificial Sequence
  Description of Artificial Sequence: Synthetic peptide
  Seed: SGTTAAQVTTTEWVETTARELPIP (PMEL_HUMAN)
  Core: VTTTEWVET
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQXTTXEXVEXTARELPIP

SEQ ID NO: 336688 - protein, 24 aa, Artificial Sequence
  Description of Artificial Sequence: Synthetic peptide
  Seed: SGTTAAQVTTTEWVETTARELPIP (PMEL_HUMAN)
  Core: WVETTAREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVTTTEXVEXTXREXPIP

SEQ ID NO: 336689 - protein, 25 aa, Artificial Sequence
  Description of Artificial Sequence: Synthetic peptide
  Seed: SGTTAAQVTTTEWVETTARELPIPE (PMEL_HUMAN)
  Core: VTTTEWVET
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQXTTXEXVEXTARELPIPE

SEQ ID NO: 336690 - protein, 25 aa, Artificial Sequence
  Description of Artificial Sequence: Synthetic peptide
  Seed: SGTTAAQVTTTEWVETTARELPIPE (PMEL_HUMAN)
  Core: WVETTAREL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVTTTEXVEXTXREXPIPE

SEQ ID NO: 336691 - protein, 25 aa, Artificial Sequence
  Description of Artificial Sequence: Synthetic peptide
  Seed: SGTTAAQVTTTEWVETTARELPIPE (PMEL_HUMAN)
  Core: ETTARELPI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SGTTAAQVTTTEWVXTTXRXLPXPE

SEQ ID NO: 336692 - protein, 15 aa, Artificial Sequence
  Description of Artificial Sequence: Synthetic peptide
  Seed: SGTTSVQVPTTEVIS (PMEL_HUMAN)
  Core: TTSVQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTSXQXPTXEVIS

SEQ ID NO: 336693 - protein, 16 aa, Artificial Sequence
  Description of Artificial Sequence: Synthetic peptide
  Seed: SGTTSVQVPTTEVIST (PMEL_HUMAN)
  Core: TTSVQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTSXQXPTXEVIST

SEQ ID NO: 336694 - protein, 17 aa, Artificial Sequence
  Description of Artificial Sequence: Synthetic peptide
  Seed: SGTTSVQVPTTEVISTA (PMEL_HUMAN)
  Core: TTSVQVPTT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXTSXQXPTXEVISTA

SEQ ID NO: 336695 - protein, 19 aa, Artificial Sequence
  Description of Artificial Sequence: Synthetic peptide
  Seed: SGTTSVQVPTTEVISTAPV (PMEL_HUMAN)
  Core: PTTEVISTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVXTTXVXSTXPV

SEQ ID NO: 336696 - protein, 20 aa, Artificial Sequence
  Description of Artificial Sequence: Synthetic peptide
  Seed: SGTTSVQVPTTEVISTAPVQ (PMEL_HUMAN)
  Core: PTTEVISTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVXTTXVXSTXPVQ

SEQ ID NO: 336697 - protein, 21 aa, Artificial Sequence
  Description of Artificial Sequence: Synthetic peptide
  Seed: SGTTSVQVPTTEVISTAPVQM (PMEL_HUMAN)
  Core: PTTEVISTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVXTTXVXSTXPVQM

SEQ ID NO: 336698 - protein, 21 aa, Artificial Sequence
  Description of Artificial Sequence: Synthetic peptide
  Seed: SGTTSVQVPTTEVISTAPVQM (PMEL_HUMAN)
  Core: VISTAPVQM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVPTTEXISXAXVQX

SEQ ID NO: 336699 - protein, 22 aa, Artificial Sequence
  Description of Artificial Sequence: Synthetic peptide
  Seed: SGTTSVQVPTTEVISTAPVQMP (PMEL_HUMAN)
  Core: PTTEVISTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVXTTXVXSTXPVQMP

SEQ ID NO: 336700 - protein, 22 aa, Artificial Sequence
  Description of Artificial Sequence: Synthetic peptide
  Seed: SGTTSVQVPTTEVISTAPVQMP (PMEL_HUMAN)
  Core: TEVISTAPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVPTXEVXSXAPXQMP

SEQ ID NO: 336701 - protein, 22 aa, Artificial Sequence
  Description of Artificial Sequence: Synthetic peptide
  Seed: SGTTSVQVPTTEVISTAPVQMP (PMEL_HUMAN)
  Core: VISTAPVQM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVPTTEXISXAXVQXP

SEQ ID NO: 336702 - protein, 23 aa, Artificial Sequence
  Description of Artificial Sequence: Synthetic peptide
  Seed: SGTTSVQVPTTEVISTAPVQMPT (PMEL_HUMAN)
  Core: PTTEVISTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVXTTXVXSTXPVQMPT

SEQ ID NO: 336703 - protein, 23 aa, Artificial Sequence
  Description of Artificial Sequence: Synthetic peptide
  Seed: SGTTSVQVPTTEVISTAPVQMPT (PMEL_HUMAN)
  Core: TEVISTAPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVPTXEVXSXAPXQMPT

SEQ ID NO: 336704 - protein, 23 aa, Artificial Sequence
  Description of Artificial Sequence: Synthetic peptide
  Seed: SGTTSVQVPTTEVISTAPVQMPT (PMEL_HUMAN)
  Core: VISTAPVQM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVPTTEXISXAXVQXPT

SEQ ID NO: 336705 - protein, 24 aa, Artificial Sequence
  Description of Artificial Sequence: Synthetic peptide
  Seed: SGTTSVQVPTTEVISTAPVQMPTA (PMEL_HUMAN)
  Core: VISTAPVQM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVPTTEXISXAXVQXPTA

SEQ ID NO: 336706 - protein, 24 aa, Artificial Sequence
  Description of Artificial Sequence: Synthetic peptide
  Seed: SGTTSVQVPTTEVISTAPVQMPTA (PMEL_HUMAN)
  Core: ISTAPVQMP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVPTTEVXSTXPXQMXTA

SEQ ID NO: 336707 - protein, 25 aa, Artificial Sequence
  Description of Artificial Sequence: Synthetic peptide
  Seed: SGTTSVQVPTTEVISTAPVQMPTAE (PMEL_HUMAN)
  Core: VISTAPVQM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVPTTEXISXAXVQXPTAE

SEQ ID NO: 336708 - protein, 25 aa, Artificial Sequence
  Description of Artificial Sequence: Synthetic peptide
  Seed: SGTTSVQVPTTEVISTAPVQMPTAE (PMEL_HUMAN)
  Core: ISTAPVQMP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SGTTSVQVPTTEVXSTXPXQMXTAE

SEQ ID NO: 336709 - protein, 14 aa, Artificial Sequence
  Description of Artificial Sequence: Synthetic peptide
  Seed: SGTYCLNVSLADTN (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTN

SEQ ID NO: 336710 - protein, 15 aa, Artificial Sequence
  Description of Artificial Sequence: Synthetic peptide
  Seed: SGTYCLNVSLADTNS (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNS

SEQ ID NO: 336711 - protein, 15 aa, Artificial Sequence
  Description of Artificial Sequence: Synthetic peptide
  Seed: SGTYCLNVSLADTNS (PMEL_HUMAN)
  Core: CLNVSLADT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGTYXLNXSXADXNS

SEQ ID NO: 336712 - protein, 16 aa, Artificial Sequence
  Description of Artificial Sequence: Synthetic peptide
  Seed: SGTYCLNVSLADTNSL (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNSL

SEQ ID NO: 336713 - protein, 16 aa, Artificial Sequence
  Description of Artificial Sequence: Synthetic peptide
  Seed: SGTYCLNVSLADTNSL (PMEL_HUMAN)
  Core: CLNVSLADT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SGTYXLNXSXADXNSL

SEQ ID NO: 336714 - protein, 16 aa, Artificial Sequence
  Description of Artificial Sequence: Synthetic peptide
  Seed: SGTYCLNVSLADTNSL (PMEL_HUMAN)
  Core: NVSLADTNS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLXVSXAXTNXL

SEQ ID NO: 336715 - protein, 17 aa, Artificial Sequence
  Description of Artificial Sequence: Synthetic peptide
  Seed: SGTYCLNVSLADTNSLA (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNSLA

SEQ ID NO: 336716 - protein, 17 aa, Artificial Sequence
  Description of Artificial Sequence: Synthetic peptide
  Seed: SGTYCLNVSLADTNSLA (PMEL_HUMAN)
  Core: LNVSLADTN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCXNVXLXDTXSLA

SEQ ID NO: 336717 - protein, 17 aa, Artificial Sequence
  Description of Artificial Sequence: Synthetic peptide
  Seed: SGTYCLNVSLADTNSLA (PMEL_HUMAN)
  Core: VSLADTNSL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNXSLXDXNSXA

SEQ ID NO: 336718 - protein, 18 aa, Artificial Sequence
  Description of Artificial Sequence: Synthetic peptide
  Seed: SGTYCLNVSLADTNSLAV (PMEL_HUMAN)
  Core: LNVSLADTN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCXNVXLXDTXSLAV

SEQ ID NO: 336719 - protein, 19 aa, Artificial Sequence
  Description of Artificial Sequence: Synthetic peptide
  Seed: SGTYCLNVSLADTNSLAVV (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNSLAVV

SEQ ID NO: 336720 - protein, 19 aa, Artificial Sequence
  Description of Artificial Sequence: Synthetic peptide
  Seed: SGTYCLNVSLADTNSLAVV (PMEL_HUMAN)
  Core: LADTNSLAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSXADXNXLAXV

SEQ ID NO: 336721 - protein, 20 aa, Artificial Sequence
  Description of Artificial Sequence: Synthetic peptide
  Seed: SGTYCLNVSLADTNSLAVVS (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNSLAVVS

SEQ ID NO: 336722 - protein, 20 aa, Artificial Sequence
  Description of Artificial Sequence: Synthetic peptide
  Seed: SGTYCLNVSLADTNSLAVVS (PMEL_HUMAN)
  Core: VSLADTNSL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNXSLXDXNSXAVVS

SEQ ID NO: 336723 - protein, 20 aa, Artificial Sequence
  Description of Artificial Sequence: Synthetic peptide
  Seed: SGTYCLNVSLADTNSLAVVS (PMEL_HUMAN)
  Core: LADTNSLAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSXADXNXLAXVS

SEQ ID NO: 336724 - protein, 21 aa, Artificial Sequence
  Description of Artificial Sequence: Synthetic peptide
  Seed: SGTYCLNVSLADTNSLAVVST (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNSLAVVST

SEQ ID NO: 336725 - protein, 21 aa, Artificial Sequence
  Description of Artificial Sequence: Synthetic peptide
  Seed: SGTYCLNVSLADTNSLAVVST (PMEL_HUMAN)
  Core: LADTNSLAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSXADXNXLAXVST

SEQ ID NO: 336726 - protein, 22 aa, Artificial Sequence
  Description of Artificial Sequence: Synthetic peptide
  Seed: SGTYCLNVSLADTNSLAVVSTQ (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNSLAVVSTQ

SEQ ID NO: 336727 - protein, 22 aa, Artificial Sequence
  Description of Artificial Sequence: Synthetic peptide
  Seed: SGTYCLNVSLADTNSLAVVSTQ (PMEL_HUMAN)
  Core: LADTNSLAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSXADXNXLAXVSTQ

SEQ ID NO: 336728 - protein, 22 aa, Artificial Sequence
  Description of Artificial Sequence: Synthetic peptide
  Seed: SGTYCLNVSLADTNSLAVVSTQ (PMEL_HUMAN)
  Core: DTNSLAVVS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSLAXTNXLXVVXTQ

SEQ ID NO: 336729 - protein, 23 aa, Artificial Sequence
  Description of Artificial Sequence: Synthetic peptide
  Seed: SGTYCLNVSLADTNSLAVVSTQL (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNSLAVVSTQL

SEQ ID NO: 336730 - protein, 23 aa, Artificial Sequence
  Description of Artificial Sequence: Synthetic peptide
  Seed: SGTYCLNVSLADTNSLAVVSTQL (PMEL_HUMAN)
  Core: LADTNSLAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSXADXNXLAXVSTQL

SEQ ID NO: 336731 - protein, 23 aa, Artificial Sequence
  Description of Artificial Sequence: Synthetic peptide
  Seed: SGTYCLNVSLADTNSLAVVSTQL (PMEL_HUMAN)
  Core: DTNSLAVVS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSLAXTNXLXVVXTQL

SEQ ID NO: 336732 - protein, 23 aa, Artificial Sequence
  Description of Artificial Sequence: Synthetic peptide
  Seed: SGTYCLNVSLADTNSLAVVSTQL (PMEL_HUMAN)
  Core: NSLAVVSTQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSLADTXSLXVXSTXL

SEQ ID NO: 336733 - protein, 24 aa, Artificial Sequence
  Description of Artificial Sequence: Synthetic peptide
  Seed: SGTYCLNVSLADTNSLAVVSTQLI (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNSLAVVSTQLI

SEQ ID NO: 336734 - protein, 24 aa, Artificial Sequence
  Description of Artificial Sequence: Synthetic peptide
  Seed: SGTYCLNVSLADTNSLAVVSTQLI (PMEL_HUMAN)
  Core: LADTNSLAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSXADXNXLAXVSTQLI

SEQ ID NO: 336735 - protein, 24 aa, Artificial Sequence
  Description of Artificial Sequence: Synthetic peptide
  Seed: SGTYCLNVSLADTNSLAVVSTQLI (PMEL_HUMAN)
  Core: DTNSLAVVS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSLAXTNXLXVVXTQLI

SEQ ID NO: 336736 - protein, 24 aa, Artificial Sequence
  Description of Artificial Sequence: Synthetic peptide
  Seed: SGTYCLNVSLADTNSLAVVSTQLI (PMEL_HUMAN)
  Core: NSLAVVSTQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSLADTXSLXVXSTXLI

SEQ ID NO: 336737 - protein, 25 aa, Artificial Sequence
  Description of Artificial Sequence: Synthetic peptide
  Seed: SGTYCLNVSLADTNSLAVVSTQLIM (PMEL_HUMAN)
  Core: YCLNVSLAD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGTXCLXVXLAXTNSLAVVSTQLIM

SEQ ID NO: 336738 - protein, 25 aa, Artificial Sequence
  Description of Artificial Sequence: Synthetic peptide
  Seed: SGTYCLNVSLADTNSLAVVSTQLIM (PMEL_HUMAN)
  Core: LADTNSLAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSXADXNXLAXVSTQLIM

SEQ ID NO: 336739 - protein, 25 aa, Artificial Sequence
  Description of Artificial Sequence: Synthetic peptide
  Seed: SGTYCLNVSLADTNSLAVVSTQLIM (PMEL_HUMAN)
  Core: DTNSLAVVS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSLAXTNXLXVVXTQLIM

SEQ ID NO: 336740 - protein, 25 aa, Artificial Sequence
  Description of Artificial Sequence: Synthetic peptide
  Seed: SGTYCLNVSLADTNSLAVVSTQLIM (PMEL_HUMAN)
  Core: NSLAVVSTQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SGTYCLNVSLADTXSLXVXSTXLIM

SEQ ID NO: 336741 - protein, 15 aa, Artificial Sequence
  Description of Artificial Sequence: Synthetic peptide
  Seed: SGYLAEADLSYTWDF (PMEL_HUMAN)
  Core: YLAEADLSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLAXAXLSXTWDF

SEQ ID NO: 336742 - protein, 15 aa, Artificial Sequence
  Description of Artificial Sequence: Synthetic peptide
  Seed: SGYLAEADLSYTWDF (PMEL_HUMAN)
  Core: LAEADLSYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGYXAEXDXSYXWDF

SEQ ID NO: 336743 - protein, 16 aa, Artificial Sequence
  Description of Artificial Sequence: Synthetic peptide
  Seed: SGYLAEADLSYTWDFG (PMEL_HUMAN)
  Core: YLAEADLSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLAXAXLSXTWDFG

SEQ ID NO: 336744 - protein, 17 aa, Artificial Sequence
  Description of Artificial Sequence: Synthetic peptide
  Seed: SGYLAEADLSYTWDFGD (PMEL_HUMAN)
  Core: YLAEADLSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLAXAXLSXTWDFGD

SEQ ID NO: 336745 - protein, 17 aa, Artificial Sequence
  Description of Artificial Sequence: Synthetic peptide
  Seed: SGYLAEADLSYTWDFGD (PMEL_HUMAN)
  Core: LSYTWDFGD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADXSYXWXFGX

SEQ ID NO: 336746 - protein, 18 aa, Artificial Sequence
  Description of Artificial Sequence: Synthetic peptide
  Seed: SGYLAEADLSYTWDFGDS (PMEL_HUMAN)
  Core: LSYTWDFGD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADXSYXWXFGXS

SEQ ID NO: 336747 - protein, 19 aa, Artificial Sequence
  Description of Artificial Sequence: Synthetic peptide
  Seed: SGYLAEADLSYTWDFGDSS (PMEL_HUMAN)
  Core: YLAEADLSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLAXAXLSXTWDFGDSS

SEQ ID NO: 336748 - protein, 19 aa, Artificial Sequence
  Description of Artificial Sequence: Synthetic peptide
  Seed: SGYLAEADLSYTWDFGDSS (PMEL_HUMAN)
  Core: LSYTWDFGD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADXSYXWXFGXSS

SEQ ID NO: 336749 - protein, 20 aa, Artificial Sequence
  Description of Artificial Sequence: Synthetic peptide
  Seed: SGYLAEADLSYTWDFGDSSG (PMEL_HUMAN)
  Core: YLAEADLSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SGXLAXAXLSXTWDFGDSSG

SEQ ID NO: 336750 - protein, 20 aa, Artificial Sequence
  Description of Artificial Sequence: Synthetic peptide
  Seed: SGYLAEADLSYTWDFGDSSG (PMEL_HUMAN)
  Core: LAEADLSYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SGYXAEXDXSYXWDFGDSSG

SEQ ID NO: 336751 - protein, 20 aa, Artificial Sequence
  Description of Artificial Sequence: Synthetic peptide
  Seed: SGYLAEADLSYTWDFGDSSG (PMEL_HUMAN)
  Core: LSYTWDFGD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADXSYXWXFGXSSG

SEQ ID NO: 336752 - protein, 21 aa, Artificial Sequence
  Description of Artificial Sequence: Synthetic peptide
  Seed: SGYLAEADLSYTWDFGDSSGT (PMEL_HUMAN)
  Core: LSYTWDFGD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADXSYXWXFGXSSGT

SEQ ID NO: 336753 - protein, 21 aa, Artificial Sequence
  Description of Artificial Sequence: Synthetic peptide
  Seed: SGYLAEADLSYTWDFGDSSGT (PMEL_HUMAN)
  Core: YTWDFGDSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADLSXTWXFXDSXGT

SEQ ID NO: 336754 - protein, 22 aa, Artificial Sequence
  Description of Artificial Sequence: Synthetic peptide
  Seed: SGYLAEADLSYTWDFGDSSGTL (PMEL_HUMAN)
  Core: LSYTWDFGD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADXSYXWXFGXSSGTL

SEQ ID NO: 336755 - protein, 22 aa, Artificial Sequence
  Description of Artificial Sequence: Synthetic peptide
  Seed: SGYLAEADLSYTWDFGDSSGTL (PMEL_HUMAN)
  Core: YTWDFGDSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADLSXTWXFXDSXGTL

SEQ ID NO: 336756 - protein, 23 aa, Artificial Sequence
  Description of Artificial Sequence: Synthetic peptide
  Seed: SGYLAEADLSYTWDFGDSSGTLI (PMEL_HUMAN)
  Core: LSYTWDFGD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADXSYXWXFGXSSGTLI

SEQ ID NO: 336757 - protein, 23 aa, Artificial Sequence
  Description of Artificial Sequence: Synthetic peptide
  Seed: SGYLAEADLSYTWDFGDSSGTLI (PMEL_HUMAN)
  Core: YTWDFGDSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADLSXTWXFXDSXGTLI

SEQ ID NO: 336758 - protein, 24 aa, Artificial Sequence
  Description of Artificial Sequence: Synthetic peptide
  Seed: SGYLAEADLSYTWDFGDSSGTLIS (PMEL_HUMAN)
  Core: LSYTWDFGD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADXSYXWXFGXSSGTLIS

SEQ ID NO: 336759 - protein, 24 aa, Artificial Sequence
  Description of Artificial Sequence: Synthetic peptide
  Seed: SGYLAEADLSYTWDFGDSSGTLIS (PMEL_HUMAN)
  Core: YTWDFGDSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADLSXTWXFXDSXGTLIS

SEQ ID NO: 336760 - protein, 25 aa, Artificial Sequence
  Description of Artificial Sequence: Synthetic peptide
  Seed: SGYLAEADLSYTWDFGDSSGTLISR (PMEL_HUMAN)
  Core: LSYTWDFGD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADXSYXWXFGXSSGTLISR

SEQ ID NO: 336761 - protein, 25 aa, Artificial Sequence
  Description of Artificial Sequence: Synthetic peptide
  Seed: SGYLAEADLSYTWDFGDSSGTLISR (PMEL_HUMAN)
  Core: YTWDFGDSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SGYLAEADLSXTWXFXDSXGTLISR

SEQ ID NO: 336762 - protein, 15 aa, Artificial Sequence
  Description of Artificial Sequence: Synthetic peptide
  Seed: SHWLRLPRIFCSCPI (PMEL_HUMAN)
  Core: WLRLPRIFC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SHXLRXPXIFXSCPI

SEQ ID NO: 336763 - protein, 15 aa, Artificial Sequence
  Description of Artificial Sequence: Synthetic peptide
  Seed: SHWLRLPRIFCSCPI (PMEL_HUMAN)
  Core: LRLPRIFCS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SHWXRLXRXFCXCPI

SEQ ID NO: 336764 - protein, 15 aa, Artificial Sequence
  Description of Artificial Sequence: Synthetic peptide
  Seed: SHWLRLPRIFCSCPI (PMEL_HUMAN)
  Core: RLPRIFCSC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SHWLXLPXIXCSXPI

SEQ ID NO: 336765 - protein, 15 aa, Artificial Sequence
  Description of Artificial Sequence: Synthetic peptide
  Seed: SHWLRLPRIFCSCPI (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPX

SEQ ID NO: 336766 - protein, 16 aa, Artificial Sequence
  Description of Artificial Sequence: Synthetic peptide
  Seed: SHWLRLPRIFCSCPIG (PMEL_HUMAN)
  Core: WLRLPRIFC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SHXLRXPXIFXSCPIG

SEQ ID NO: 336767 - protein, 16 aa, Artificial Sequence
  Description of Artificial Sequence: Synthetic peptide
  Seed: SHWLRLPRIFCSCPIG (PMEL_HUMAN)
  Core: LRLPRIFCS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SHWXRLXRXFCXCPIG

SEQ ID NO: 336768 - protein, 16 aa, Artificial Sequence
  Description of Artificial Sequence: Synthetic peptide
  Seed: SHWLRLPRIFCSCPIG (PMEL_HUMAN)
  Core: RLPRIFCSC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SHWLXLPXIXCSXPIG

SEQ ID NO: 336769 - protein, 16 aa, Artificial Sequence
  Description of Artificial Sequence: Synthetic peptide
  Seed: SHWLRLPRIFCSCPIG (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXG

SEQ ID NO: 336770 - protein, 17 aa, Artificial Sequence
  Description of Artificial Sequence: Synthetic peptide
  Seed: SHWLRLPRIFCSCPIGE (PMEL_HUMAN)
  Core: WLRLPRIFC
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SHXLRXPXIFXSCPIGE

SEQ ID NO: 336771 - protein, 17 aa, Artificial Sequence
  Description of Artificial Sequence: Synthetic peptide
  Seed: SHWLRLPRIFCSCPIGE (PMEL_HUMAN)
  Core: LRLPRIFCS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SHWXRLXRXFCXCPIGE

SEQ ID NO: 336772 - protein, 17 aa, Artificial Sequence
  Description of Artificial Sequence: Synthetic peptide
  Seed: SHWLRLPRIFCSCPIGE (PMEL_HUMAN)
  Core: RLPRIFCSC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SHWLXLPXIXCSXPIGE

SEQ ID NO: 336773 - protein, 17 aa, Artificial Sequence
  Description of Artificial Sequence: Synthetic peptide
  Seed: SHWLRLPRIFCSCPIGE (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXGE

SEQ ID NO: 336774 - protein, 17 aa, Artificial Sequence
  Description of Artificial Sequence: Synthetic peptide
  Seed: SHWLRLPRIFCSCPIGE (PMEL_HUMAN)
  Core: RIFCSCPIG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPXIFXSXPIXE

SEQ ID NO: 336775 - protein, 17 aa, Artificial Sequence
  Description of Artificial Sequence: Synthetic peptide
  Seed: SHWLRLPRIFCSCPIGE (PMEL_HUMAN)
  Core: IFCSCPIGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRXFCXCXIGX

SEQ ID NO: 336776 - protein, 18 aa, Artificial Sequence
  Description of Artificial Sequence: Synthetic peptide
  Seed: SHWLRLPRIFCSCPIGEN (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXGEN

SEQ ID NO: 336777 - protein, 19 aa, Artificial Sequence
  Description of Artificial Sequence: Synthetic peptide
  Seed: SHWLRLPRIFCSCPIGENS (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXGENS

SEQ ID NO: 336778 - protein, 19 aa, Artificial Sequence
  Description of Artificial Sequence: Synthetic peptide
  Seed: SHWLRLPRIFCSCPIGENS (PMEL_HUMAN)
  Core: RIFCSCPIG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPXIFXSXPIXENS

SEQ ID NO: 336779 - protein, 19 aa, Artificial Sequence
  Description of Artificial Sequence: Synthetic peptide
  Seed: SHWLRLPRIFCSCPIGENS (PMEL_HUMAN)
  Core: IFCSCPIGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRXFCXCXIGXNS

SEQ ID NO: 336780 - protein, 19 aa, Artificial Sequence
  Description of Artificial Sequence: Synthetic peptide
  Seed: SHWLRLPRIFCSCPIGENS (PMEL_HUMAN)
  Core: FCSCPIGEN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRIXCSXPXGEXS

SEQ ID NO: 336781 - protein, 20 aa, Artificial Sequence
  Description of Artificial Sequence: Synthetic peptide
  Seed: SHWLRLPRIFCSCPIGENSP (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXGENSP

SEQ ID NO: 336782 - protein, 20 aa, Artificial Sequence
  Description of Artificial Sequence: Synthetic peptide
  Seed: SHWLRLPRIFCSCPIGENSP (PMEL_HUMAN)
  Core: RIFCSCPIG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPXIFXSXPIXENSP

SEQ ID NO: 336783 - protein, 20 aa, Artificial Sequence
  Description of Artificial Sequence: Synthetic peptide
  Seed: SHWLRLPRIFCSCPIGENSP (PMEL_HUMAN)
  Core: IFCSCPIGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRXFCXCXIGXNSP

SEQ ID NO: 336784 - protein, 20 aa, Artificial Sequence
  Description of Artificial Sequence: Synthetic peptide
  Seed: SHWLRLPRIFCSCPIGENSP (PMEL_HUMAN)
  Core: FCSCPIGEN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRIXCSXPXGEXSP

SEQ ID NO: 336785 - protein, 21 aa, Artificial Sequence
  Description of Artificial Sequence: Synthetic peptide
  Seed: SHWLRLPRIFCSCPIGENSPL (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXGENSPL

SEQ ID NO: 336786 - protein, 21 aa, Artificial Sequence
  Description of Artificial Sequence: Synthetic peptide
  Seed: SHWLRLPRIFCSCPIGENSPL (PMEL_HUMAN)
  Core: RIFCSCPIG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPXIFXSXPIXENSPL

SEQ ID NO: 336787 - protein, 21 aa, Artificial Sequence
  Description of Artificial Sequence: Synthetic peptide
  Seed: SHWLRLPRIFCSCPIGENSPL (PMEL_HUMAN)
  Core: FCSCPIGEN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRIXCSXPXGEXSPL

SEQ ID NO: 336788 - protein, 22 aa, Artificial Sequence
  Description of Artificial Sequence: Synthetic peptide
  Seed: SHWLRLPRIFCSCPIGENSPLL (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXGENSPLL

SEQ ID NO: 336789 - protein, 22 aa, Artificial Sequence
  Description of Artificial Sequence: Synthetic peptide
  Seed: SHWLRLPRIFCSCPIGENSPLL (PMEL_HUMAN)
  Core: RIFCSCPIG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPXIFXSXPIXENSPLL

SEQ ID NO: 336790 - protein, 22 aa, Artificial Sequence
  Description of Artificial Sequence: Synthetic peptide
  Seed: SHWLRLPRIFCSCPIGENSPLL (PMEL_HUMAN)
  Core: FCSCPIGEN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRIXCSXPXGEXSPLL

SEQ ID NO: 336791 - protein, 23 aa, Artificial Sequence
  Description of Artificial Sequence: Synthetic peptide
  Seed: SHWLRLPRIFCSCPIGENSPLLS (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXGENSPLLS

SEQ ID NO: 336792 - protein, 23 aa, Artificial Sequence
  Description of Artificial Sequence: Synthetic peptide
  Seed: SHWLRLPRIFCSCPIGENSPLLS (PMEL_HUMAN)
  Core: IFCSCPIGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRXFCXCXIGXNSPLLS

SEQ ID NO: 336793 - protein, 23 aa, Artificial Sequence
  Description of Artificial Sequence: Synthetic peptide
  Seed: SHWLRLPRIFCSCPIGENSPLLS (PMEL_HUMAN)
  Core: FCSCPIGEN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRIXCSXPXGEXSPLLS

SEQ ID NO: 336794 - protein, 24 aa, Artificial Sequence
  Description of Artificial Sequence: Synthetic peptide
  Seed: SHWLRLPRIFCSCPIGENSPLLSG (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXGENSPLLSG

SEQ ID NO: 336795 - protein, 24 aa, Artificial Sequence
  Description of Artificial Sequence: Synthetic peptide
  Seed: SHWLRLPRIFCSCPIGENSPLLSG (PMEL_HUMAN)
  Core: IFCSCPIGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRXFCXCXIGXNSPLLSG

SEQ ID NO: 336796 - protein, 24 aa, Artificial Sequence
  Description of Artificial Sequence: Synthetic peptide
  Seed: SHWLRLPRIFCSCPIGENSPLLSG (PMEL_HUMAN)
  Core: FCSCPIGEN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRIXCSXPXGEXSPLLSG

SEQ ID NO: 336797 - protein, 25 aa, Artificial Sequence
  Description of Artificial Sequence: Synthetic peptide
  Seed: SHWLRLPRIFCSCPIGENSPLLSGQ (PMEL_HUMAN)
  Core: PRIFCSCPI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLXRIXCXCPXGENSPLLSGQ

SEQ ID NO: 336798 - protein, 25 aa, Artificial Sequence
  Description of Artificial Sequence: Synthetic peptide
  Seed: SHWLRLPRIFCSCPIGENSPLLSGQ (PMEL_HUMAN)
  Core: FCSCPIGEN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRIXCSXPXGEXSPLLSGQ

SEQ ID NO: 336799 - protein, 25 aa, Artificial Sequence
  Description of Artificial Sequence: Synthetic peptide
  Seed: SHWLRLPRIFCSCPIGENSPLLSGQ (PMEL_HUMAN)
  Core: IGENSPLLS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SHWLRLPRIFCSCPXGEXSXLLXGQ

SEQ ID NO: 336800 - protein, 13 aa, Artificial Sequence
  Description of Artificial Sequence: Synthetic peptide
  Seed: SIALNFPGSQKVL (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVL

SEQ ID NO: 336801 - protein, 14 aa, Artificial Sequence
  Description of Artificial Sequence: Synthetic peptide
  Seed: SIALNFPGSQKVLP (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLP

SEQ ID NO: 336802 - protein, 14 aa, Artificial Sequence
  Description of Artificial Sequence: Synthetic peptide
  Seed: SIALNFPGSQKVLP (PMEL_HUMAN)
  Core: LNFPGSQKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIAXNFXGXQKXLP

SEQ ID NO: 336803 - protein, 15 aa, Artificial Sequence
  Description of Artificial Sequence: Synthetic peptide
  Seed: SIALNFPGSQKVLPD (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLPD

SEQ ID NO: 336804 - protein, 15 aa, Artificial Sequence
  Description of Artificial Sequence: Synthetic peptide
  Seed: SIALNFPGSQKVLPD (PMEL_HUMAN)
  Core: LNFPGSQKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIAXNFXGXQKXLPD

SEQ ID NO: 336805 - protein, 16 aa, Artificial Sequence
  Description of Artificial Sequence: Synthetic peptide
  Seed: SIALNFPGSQKVLPDG (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLPDG

SEQ ID NO: 336806 - protein, 16 aa, Artificial Sequence
  Description of Artificial Sequence: Synthetic peptide
  Seed: SIALNFPGSQKVLPDG (PMEL_HUMAN)
  Core: LNFPGSQKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIAXNFXGXQKXLPDG

SEQ ID NO: 336807 - protein, 17 aa, Artificial Sequence
  Description of Artificial Sequence: Synthetic peptide
  Seed: SIALNFPGSQKVLPDGQ (PMEL_HUMAN)
  Core: LNFPGSQKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIAXNFXGXQKXLPDGQ

SEQ ID NO: 336808 - protein, 19 aa, Artificial Sequence
  Description of Artificial Sequence: Synthetic peptide
  Seed: SIALNFPGSQKVLPDGQVI (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLPDGQVI

SEQ ID NO: 336809 - protein, 19 aa, Artificial Sequence
  Description of Artificial Sequence: Synthetic peptide
  Seed: SIALNFPGSQKVLPDGQVI (PMEL_HUMAN)
  Core: LNFPGSQKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIAXNFXGXQKXLPDGQVI

SEQ ID NO: 336810 - protein, 20 aa, Artificial Sequence
  Description of Artificial Sequence: Synthetic peptide
  Seed: SIALNFPGSQKVLPDGQVIW (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLPDGQVIW

SEQ ID NO: 336811 - protein, 20 aa, Artificial Sequence
  Description of Artificial Sequence: Synthetic peptide
  Seed: SIALNFPGSQKVLPDGQVIW (PMEL_HUMAN)
  Core: LNFPGSQKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIAXNFXGXQKXLPDGQVIW

SEQ ID NO: 336812 - protein, 21 aa, Artificial Sequence
  Description of Artificial Sequence: Synthetic peptide
  Seed: SIALNFPGSQKVLPDGQVIWV (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLPDGQVIWV

SEQ ID NO: 336813 - protein, 22 aa, Artificial Sequence
  Description of Artificial Sequence: Synthetic peptide
  Seed: SIALNFPGSQKVLPDGQVIWVN (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLPDGQVIWVN

SEQ ID NO: 336814 - protein, 23 aa, Artificial Sequence
  Description of Artificial Sequence: Synthetic peptide
  Seed: SIALNFPGSQKVLPDGQVIWVNN (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLPDGQVIWVNN

SEQ ID NO: 336815 - protein, 24 aa, Artificial Sequence
  Description of Artificial Sequence: Synthetic peptide
  Seed: SIALNFPGSQKVLPDGQVIWVNNT (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLPDGQVIWVNNT

SEQ ID NO: 336816 - protein, 25 aa, Artificial Sequence
  Description of Artificial Sequence: Synthetic peptide
  Seed: SIALNFPGSQKVLPDGQVIWVNNTI (PMEL_HUMAN)
  Core: IALNFPGSQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXALXFXGSXKVLPDGQVIWVNNTI

SEQ ID NO: 336817 - protein, 25 aa, Artificial Sequence
  Description of Artificial Sequence: Synthetic peptide
  Seed: SIALNFPGSQKVLPDGQVIWVNNTI (PMEL_HUMAN)
  Core: QKVLPDGQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SIALNFPGSXKVXPXGQXIWVNNTI

SEQ ID NO: 336818 - protein, 25 aa, Artificial Sequence
  Description of Artificial Sequence: Synthetic peptide
  Seed: SIALNFPGSQKVLPDGQVIWVNNTI (PMEL_HUMAN)
  Core: VLPDGQVIW
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SIALNFPGSQKXLPXGXVIXVNNTI

SEQ ID NO: 336819 - protein, 13 aa, Artificial Sequence
  Description of Artificial Sequence: Synthetic peptide
  Seed: SIGTGRAMLGTHT (PMEL_HUMAN)
  Core: IGTGRAMLG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXGTXRXMLXTHT

SEQ ID NO: 336820 - protein, 14 aa, Artificial Sequence
  Description of Artificial Sequence: Synthetic peptide
  Seed: SIGTGRAMLGTHTM (PMEL_HUMAN)
  Core: IGTGRAMLG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXGTXRXMLXTHTM

SEQ ID NO: 336821 - protein, 14 aa, Artificial Sequence
  Description of Artificial Sequence: Synthetic peptide
  Seed: SIGTGRAMLGTHTM (PMEL_HUMAN)
  Core: GRAMLGTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIGTXRAXLXTHXM

SEQ ID NO: 336822 - protein, 15 aa, Artificial Sequence
  Description of Artificial Sequence: Synthetic peptide
  Seed: SIGTGRAMLGTHTME (PMEL_HUMAN)
  Core: IGTGRAMLG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXGTXRXMLXTHTME

SEQ ID NO: 336823 - protein, 15 aa, Artificial Sequence
  Description of Artificial Sequence: Synthetic peptide
  Seed: SIGTGRAMLGTHTME (PMEL_HUMAN)
  Core: GRAMLGTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIGTXRAXLXTHXME

SEQ ID NO: 336824 - protein, 15 aa, Artificial Sequence
  Description of Artificial Sequence: Synthetic peptide
  Seed: SIGTGRAMLGTHTME (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXE

SEQ ID NO: 336825 - protein, 16 aa, Artificial Sequence
  Description of Artificial Sequence: Synthetic peptide
  Seed: SIGTGRAMLGTHTMEV (PMEL_HUMAN)
  Core: IGTGRAMLG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXGTXRXMLXTHTMEV

SEQ ID NO: 336826 - protein, 16 aa, Artificial Sequence
  Description of Artificial Sequence: Synthetic peptide
  Seed: SIGTGRAMLGTHTMEV (PMEL_HUMAN)
  Core: GRAMLGTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIGTXRAXLXTHXMEV

SEQ ID NO: 336827 - protein, 16 aa, Artificial Sequence
  Description of Artificial Sequence: Synthetic peptide
  Seed: SIGTGRAMLGTHTMEV (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXEV

SEQ ID NO: 336828 - protein, 16 aa, Artificial Sequence
  Description of Artificial Sequence: Synthetic peptide
  Seed: SIGTGRAMLGTHTMEV (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEX

SEQ ID NO: 336829 - protein, 17 aa, Artificial Sequence
  Description of Artificial Sequence: Synthetic peptide
  Seed: SIGTGRAMLGTHTMEVT (PMEL_HUMAN)
  Core: IGTGRAMLG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXGTXRXMLXTHTMEVT

SEQ ID NO: 336830 - protein, 17 aa, Artificial Sequence
  Description of Artificial Sequence: Synthetic peptide
  Seed: SIGTGRAMLGTHTMEVT (PMEL_HUMAN)
  Core: GRAMLGTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIGTXRAXLXTHXMEVT

SEQ ID NO: 336831 - protein, 17 aa, Artificial Sequence
  Description of Artificial Sequence: Synthetic peptide
  Seed: SIGTGRAMLGTHTMEVT (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXEVT

SEQ ID NO: 336832 - protein, 17 aa, Artificial Sequence
  Description of Artificial Sequence: Synthetic peptide
  Seed: SIGTGRAMLGTHTMEVT (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEXT

SEQ ID NO: 336833 - protein, 18 aa, Artificial Sequence
  Description of Artificial Sequence: Synthetic peptide
  Seed: SIGTGRAMLGTHTMEVTV (PMEL_HUMAN)
  Core: IGTGRAMLG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXGTXRXMLXTHTMEVTV

SEQ ID NO: 336834 - protein, 18 aa, Artificial Sequence
  Description of Artificial Sequence: Synthetic peptide
  Seed: SIGTGRAMLGTHTMEVTV (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEXTV

SEQ ID NO: 336835 - protein, 19 aa, Artificial Sequence
  Description of Artificial Sequence: Synthetic peptide
  Seed: SIGTGRAMLGTHTMEVTVY (PMEL_HUMAN)
  Core: IGTGRAMLG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXGTXRXMLXTHTMEVTVY

SEQ ID NO: 336836 - protein, 19 aa, Artificial Sequence
  Description of Artificial Sequence: Synthetic peptide
  Seed: SIGTGRAMLGTHTMEVTVY (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXEVTVY

SEQ ID NO: 336837 - protein, 19 aa, Artificial Sequence
  Description of Artificial Sequence: Synthetic peptide
  Seed: SIGTGRAMLGTHTMEVTVY (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEXTVY

SEQ ID NO: 336838 - protein, 20 aa, Artificial Sequence
  Description of Artificial Sequence: Synthetic peptide
  Seed: SIGTGRAMLGTHTMEVTVYH (PMEL_HUMAN)
  Core: IGTGRAMLG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXGTXRXMLXTHTMEVTVYH

SEQ ID NO: 336839 - protein, 20 aa, Artificial Sequence
  Description of Artificial Sequence: Synthetic peptide
  Seed: SIGTGRAMLGTHTMEVTVYH (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXEVTVYH

SEQ ID NO: 336840 - protein, 20 aa, Artificial Sequence
  Description of Artificial Sequence: Synthetic peptide
  Seed: SIGTGRAMLGTHTMEVTVYH (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEXTVYH

SEQ ID NO: 336841 - protein, 20 aa, Artificial Sequence
  Description of Artificial Sequence: Synthetic peptide
  Seed: SIGTGRAMLGTHTMEVTVYH (PMEL_HUMAN)
  Core: LGTHTMEVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMXGTXTXEVXVYH

SEQ ID NO: 336842 - protein, 21 aa, Artificial Sequence
  Description of Artificial Sequence: Synthetic peptide
  Seed: SIGTGRAMLGTHTMEVTVYHR (PMEL_HUMAN)
  Core: IGTGRAMLG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXGTXRXMLXTHTMEVTVYHR

SEQ ID NO: 336843 - protein, 21 aa, Artificial Sequence
  Description of Artificial Sequence: Synthetic peptide
  Seed: SIGTGRAMLGTHTMEVTVYHR (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXEVTVYHR

SEQ ID NO: 336844 - protein, 21 aa, Artificial Sequence
  Description of Artificial Sequence: Synthetic peptide
  Seed: SIGTGRAMLGTHTMEVTVYHR (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEXTVYHR

SEQ ID NO: 336845 - protein, 21 aa, Artificial Sequence
  Description of Artificial Sequence: Synthetic peptide
  Seed: SIGTGRAMLGTHTMEVTVYHR (PMEL_HUMAN)
  Core: LGTHTMEVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMXGTXTXEVXVYHR

SEQ ID NO: 336846 - protein, 21 aa, Artificial Sequence
  Description of Artificial Sequence: Synthetic peptide
  Seed: SIGTGRAMLGTHTMEVTVYHR (PMEL_HUMAN)
  Core: THTMEVTVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGXHTXEXTVXHR

SEQ ID NO: 336847 - protein, 22 aa, Artificial Sequence
  Description of Artificial Sequence: Synthetic peptide
  Seed: SIGTGRAMLGTHTMEVTVYHRR (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXEVTVYHRR

SEQ ID NO: 336848 - protein, 22 aa, Artificial Sequence
  Description of Artificial Sequence: Synthetic peptide
  Seed: SIGTGRAMLGTHTMEVTVYHRR (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEXTVYHRR

SEQ ID NO: 336849 - protein, 22 aa, Artificial Sequence
  Description of Artificial Sequence: Synthetic peptide
  Seed: SIGTGRAMLGTHTMEVTVYHRR (PMEL_HUMAN)
  Core: LGTHTMEVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMXGTXTXEVXVYHRR

SEQ ID NO: 336850 - protein, 22 aa, Artificial Sequence
  Description of Artificial Sequence: Synthetic peptide
  Seed: SIGTGRAMLGTHTMEVTVYHRR (PMEL_HUMAN)
  Core: THTMEVTVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGXHTXEXTVXHRR

SEQ ID NO: 336851 - protein, 23 aa, Artificial Sequence
  Description of Artificial Sequence: Synthetic peptide
  Seed: SIGTGRAMLGTHTMEVTVYHRRG (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXEVTVYHRRG

SEQ ID NO: 336852 - protein, 23 aa, Artificial Sequence
  Description of Artificial Sequence: Synthetic peptide
  Seed: SIGTGRAMLGTHTMEVTVYHRRG (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEXTVYHRRG

SEQ ID NO: 336853 - protein, 23 aa, Artificial Sequence
  Description of Artificial Sequence: Synthetic peptide
  Seed: SIGTGRAMLGTHTMEVTVYHRRG (PMEL_HUMAN)
  Core: LGTHTMEVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMXGTXTXEVXVYHRRG

SEQ ID NO: 336854 - protein, 23 aa, Artificial Sequence
  Description of Artificial Sequence: Synthetic peptide
  Seed: SIGTGRAMLGTHTMEVTVYHRRG (PMEL_HUMAN)
  Core: THTMEVTVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGXHTXEXTVXHRRG

SEQ ID NO: 336855 - protein, 23 aa, Artificial Sequence
  Description of Artificial Sequence: Synthetic peptide
  Seed: SIGTGRAMLGTHTMEVTVYHRRG (PMEL_HUMAN)
  Core: MEVTVYHRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGTHTXEVXVXHRXG

SEQ ID NO: 336856 - protein, 24 aa, Artificial Sequence
  Description of Artificial Sequence: Synthetic peptide
  Seed: SIGTGRAMLGTHTMEVTVYHRRGS (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXEVTVYHRRGS

SEQ ID NO: 336857 - protein, 24 aa, Artificial Sequence
  Description of Artificial Sequence: Synthetic peptide
  Seed: SIGTGRAMLGTHTMEVTVYHRRGS (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEXTVYHRRGS

SEQ ID NO: 336858 - protein, 24 aa, Artificial Sequence
  Description of Artificial Sequence: Synthetic peptide
  Seed: SIGTGRAMLGTHTMEVTVYHRRGS (PMEL_HUMAN)
  Core: LGTHTMEVT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMXGTXTXEVXVYHRRGS

SEQ ID NO: 336859 - protein, 24 aa, Artificial Sequence
  Description of Artificial Sequence: Synthetic peptide
  Seed: SIGTGRAMLGTHTMEVTVYHRRGS (PMEL_HUMAN)
  Core: THTMEVTVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGXHTXEXTVXHRRGS

SEQ ID NO: 336860 - protein, 24 aa, Artificial Sequence
  Description of Artificial Sequence: Synthetic peptide
  Seed: SIGTGRAMLGTHTMEVTVYHRRGS (PMEL_HUMAN)
  Core: MEVTVYHRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGTHTXEVXVXHRXGS

SEQ ID NO: 336861 - protein, 24 aa, Artificial Sequence
  Description of Artificial Sequence: Synthetic peptide
  Seed: SIGTGRAMLGTHTMEVTVYHRRGS (PMEL_HUMAN)
  Core: VTVYHRRGS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGTHTMEXTVXHXRGX

SEQ ID NO: 336862 - protein, 25 aa, Artificial Sequence
  Description of Artificial Sequence: Synthetic peptide
  Seed: SIGTGRAMLGTHTMEVTVYHRRGSR (PMEL_HUMAN)
  Core: RAMLGTHTM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGXAMXGXHTXEVTVYHRRGSR

SEQ ID NO: 336863 - protein, 25 aa, Artificial Sequence
  Description of Artificial Sequence: Synthetic peptide
  Seed: SIGTGRAMLGTHTMEVTVYHRRGSR (PMEL_HUMAN)
  Core: MLGTHTMEV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAXLGXHXMEXTVYHRRGSR

SEQ ID NO: 336864 - protein, 25 aa, Artificial Sequence
  Description of Artificial Sequence: Synthetic peptide
  Seed: SIGTGRAMLGTHTMEVTVYHRRGSR (PMEL_HUMAN)
  Core: THTMEVTVY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGXHTXEXTVXHRRGSR

SEQ ID NO: 336865 - protein, 25 aa, Artificial Sequence
  Description of Artificial Sequence: Synthetic peptide
  Seed: SIGTGRAMLGTHTMEVTVYHRRGSR (PMEL_HUMAN)
  Core: MEVTVYHRR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGTHTXEVXVXHRXGSR

SEQ ID NO: 336866 - protein, 25 aa, Artificial Sequence
  Description of Artificial Sequence: Synthetic peptide
  Seed: SIGTGRAMLGTHTMEVTVYHRRGSR (PMEL_HUMAN)
  Core: VTVYHRRGS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SIGTGRAMLGTHTMEXTVXHXRGXR

SEQ ID NO: 336867 - protein, 15 aa, Artificial Sequence
  Description of Artificial Sequence: Synthetic peptide
  Seed: SIMSTESITGSLGPL (PMEL_HUMAN)
  Core: MSTESITGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SIXSTXSXTGXLGPL

SEQ ID NO: 336868 - protein, 15 aa, Artificial Sequence
  Description of Artificial Sequence: Synthetic peptide
  Seed: SIMSTESITGSLGPL (PMEL_HUMAN)
  Core: TESITGSLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIMSXESXTXSLXPL

SEQ ID NO: 336869 - protein, 16 aa, Artificial Sequence
  Description of Artificial Sequence: Synthetic peptide
  Seed: SIMSTESITGSLGPLL (PMEL_HUMAN)
  Core: MSTESITGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SIXSTXSXTGXLGPLL

SEQ ID NO: 336870 - protein, 16 aa, Artificial Sequence
  Description of Artificial Sequence: Synthetic peptide
  Seed: SIMSTESITGSLGPLL (PMEL_HUMAN)
  Core: TESITGSLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIMSXESXTXSLXPLL

SEQ ID NO: 336871 - protein, 16 aa, Artificial Sequence
  Description of Artificial Sequence: Synthetic peptide
  Seed: SIMSTESITGSLGPLL (PMEL_HUMAN)
  Core: ITGSLGPLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESXTGXLXPLX

SEQ ID NO: 336872 - protein, 17 aa, Artificial Sequence
  Description of Artificial Sequence: Synthetic peptide
  Seed: SIMSTESITGSLGPLLD (PMEL_HUMAN)
  Core: SITGSLGPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTEXITXSXGPXLD

SEQ ID NO: 336873 - protein, 17 aa, Artificial Sequence
  Description of Artificial Sequence: Synthetic peptide
  Seed: SIMSTESITGSLGPLLD (PMEL_HUMAN)
  Core: ITGSLGPLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESXTGXLXPLXD

SEQ ID NO: 336874 - protein, 19 aa, Artificial Sequence
  Description of Artificial Sequence: Synthetic peptide
  Seed: SIMSTESITGSLGPLLDGT (PMEL_HUMAN)
  Core: ITGSLGPLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESXTGXLXPLXDGT

SEQ ID NO: 336875 - protein, 20 aa, Artificial Sequence
  Description of Artificial Sequence: Synthetic peptide
  Seed: SIMSTESITGSLGPLLDGTA (PMEL_HUMAN)
  Core: SITGSLGPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTEXITXSXGPXLDGTA

SEQ ID NO: 336876 - protein, 20 aa, Artificial Sequence
  Description of Artificial Sequence: Synthetic peptide
  Seed: SIMSTESITGSLGPLLDGTA (PMEL_HUMAN)
  Core: ITGSLGPLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESXTGXLXPLXDGTA

SEQ ID NO: 336877 - protein, 21 aa, Artificial Sequence
  Description of Artificial Sequence: Synthetic peptide
  Seed: SIMSTESITGSLGPLLDGTAT (PMEL_HUMAN)
  Core: ITGSLGPLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESXTGXLXPLXDGTAT

SEQ ID NO: 336878 - protein, 22 aa, Artificial Sequence
  Description of Artificial Sequence: Synthetic peptide
  Seed: SIMSTESITGSLGPLLDGTATL (PMEL_HUMAN)
  Core: ITGSLGPLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESXTGXLXPLXDGTATL

SEQ ID NO: 336879 - protein, 23 aa, Artificial Sequence
  Description of Artificial Sequence: Synthetic peptide
  Seed: SIMSTESITGSLGPLLDGTATLR (PMEL_HUMAN)
  Core: ITGSLGPLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESXTGXLXPLXDGTATLR

SEQ ID NO: 336880 - protein, 24 aa, Artificial Sequence
  Description of Artificial Sequence: Synthetic peptide
  Seed: SIMSTESITGSLGPLLDGTATLRL (PMEL_HUMAN)
  Core: ITGSLGPLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESXTGXLXPLXDGTATLRL

SEQ ID NO: 336881 - protein, 25 aa, Artificial Sequence
  Description of Artificial Sequence: Synthetic peptide
  Seed: SIMSTESITGSLGPLLDGTATLRLV (PMEL_HUMAN)
  Core: ITGSLGPLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESXTGXLXPLXDGTATLRLV

SEQ ID NO: 336882 - protein, 25 aa, Artificial Sequence
  Description of Artificial Sequence: Synthetic peptide
  Seed: SIMSTESITGSLGPLLDGTATLRLV (PMEL_HUMAN)
  Core: LGPLLDGTA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESITGSXGPXLXGTXTLRLV

SEQ ID NO: 336883 - protein, 25 aa, Artificial Sequence
  Description of Artificial Sequence: Synthetic peptide
  Seed: SIMSTESITGSLGPLLDGTATLRLV (PMEL_HUMAN)
  Core: LDGTATLRL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SIMSTESITGSLGPLXDGXAXLRXV

SEQ ID NO: 336884 - protein, 14 aa, Artificial Sequence
  Description of Artificial Sequence: Synthetic peptide
  Seed: SITGSLGPLLDGTA (PMEL_HUMAN)
  Core: ITGSLGPLL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXTGXLXPLXDGTA

SEQ ID NO: 336885 - protein, 15 aa, Artificial Sequence
  Description of Artificial Sequence: Synthetic peptide
  Seed: SITGSLGPLLDGTAT (PMEL_HUMAN)
  Core: ITGSLGPLL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXTGXLXPLXDGTAT

SEQ ID NO: 336886 - protein, 15 aa, Artificial Sequence
  Description of Artificial Sequence: Synthetic peptide
  Seed: SITGSLGPLLDGTAT (PMEL_HUMAN)
  Core: LGPLLDGTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SITGSXGPXLXGTXT

SEQ ID NO: 336887 - protein, 16 aa, Artificial Sequence
  Description of Artificial Sequence: Synthetic peptide
  Seed: SITGSLGPLLDGTATL (PMEL_HUMAN)
  Core: ITGSLGPLL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXTGXLXPLXDGTATL

SEQ ID NO: 336888 - protein, 16 aa, Artificial Sequence
  Description of Artificial Sequence: Synthetic peptide
  Seed: SITGSLGPLLDGTATL (PMEL_HUMAN)
  Core: LGPLLDGTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SITGSXGPXLXGTXTL

SEQ ID NO: 336889 - protein, 17 aa, Artificial Sequence
  Description of Artificial Sequence: Synthetic peptide
  Seed: SITGSLGPLLDGTATLR (PMEL_HUMAN)
  Core: LGPLLDGTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SITGSXGPXLXGTXTLR

SEQ ID NO: 336890 - protein, 19 aa, Artificial Sequence
  Description of Artificial Sequence: Synthetic peptide
  Seed: SITGSLGPLLDGTATLRLV (PMEL_HUMAN)
  Core: LGPLLDGTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SITGSXGPXLXGTXTLRLV

SEQ ID NO: 336891 - protein, 19 aa, Artificial Sequence
  Description of Artificial Sequence: Synthetic peptide
  Seed: SITGSLGPLLDGTATLRLV (PMEL_HUMAN)
  Core: LLDGTATLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPXLDXTXTLXLV

SEQ ID NO: 336892 - protein, 19 aa, Artificial Sequence
  Description of Artificial Sequence: Synthetic peptide
  Seed: SITGSLGPLLDGTATLRLV (PMEL_HUMAN)
  Core: LDGTATLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLXDGXAXLRXV

SEQ ID NO: 336893 - protein, 20 aa, Artificial Sequence
  Description of Artificial Sequence: Synthetic peptide
  Seed: SITGSLGPLLDGTATLRLVK (PMEL_HUMAN)
  Core: LGPLLDGTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SITGSXGPXLXGTXTLRLVK

SEQ ID NO: 336894 - protein, 20 aa, Artificial Sequence
  Description of Artificial Sequence: Synthetic peptide
  Seed: SITGSLGPLLDGTATLRLVK (PMEL_HUMAN)
  Core: LLDGTATLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPXLDXTXTLXLVK

SEQ ID NO: 336895 - protein, 20 aa, Artificial Sequence
  Description of Artificial Sequence: Synthetic peptide
  Seed: SITGSLGPLLDGTATLRLVK (PMEL_HUMAN)
  Core: LDGTATLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLXDGXAXLRXVK

SEQ ID NO: 336896 - protein, 21 aa, Artificial Sequence
  Description of Artificial Sequence: Synthetic peptide
  Seed: SITGSLGPLLDGTATLRLVKR (PMEL_HUMAN)
  Core: LDGTATLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLXDGXAXLRXVKR

SEQ ID NO: 336897 - protein, 22 aa, Artificial Sequence
  Description of Artificial Sequence: Synthetic peptide
  Seed: SITGSLGPLLDGTATLRLVKRQ (PMEL_HUMAN)
  Core: LDGTATLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLXDGXAXLRXVKRQ

SEQ ID NO: 336898 - protein, 22 aa, Artificial Sequence
  Description of Artificial Sequence: Synthetic peptide
  Seed: SITGSLGPLLDGTATLRLVKRQ (PMEL_HUMAN)
  Core: DGTATLRLV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLLXGTXTXRLXKRQ

SEQ ID NO: 336899 - protein, 23 aa, Artificial Sequence
  Description of Artificial Sequence: Synthetic peptide
  Seed: SITGSLGPLLDGTATLRLVKRQV (PMEL_HUMAN)
  Core: LDGTATLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLXDGXAXLRXVKRQV

SEQ ID NO: 336900 - protein, 23 aa, Artificial Sequence
  Description of Artificial Sequence: Synthetic peptide
  Seed: SITGSLGPLLDGTATLRLVKRQV (PMEL_HUMAN)
  Core: DGTATLRLV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLLXGTXTXRLXKRQV

SEQ ID NO: 336901 - protein, 24 aa, Artificial Sequence
  Description of Artificial Sequence: Synthetic peptide
  Seed: SITGSLGPLLDGTATLRLVKRQVP (PMEL_HUMAN)
  Core: LDGTATLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLXDGXAXLRXVKRQVP

SEQ ID NO: 336902 - protein, 24 aa, Artificial Sequence
  Description of Artificial Sequence: Synthetic peptide
  Seed: SITGSLGPLLDGTATLRLVKRQVP (PMEL_HUMAN)
  Core: DGTATLRLV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLLXGTXTXRLXKRQVP

SEQ ID NO: 336903 - protein, 24 aa, Artificial Sequence
  Description of Artificial Sequence: Synthetic peptide
  Seed: SITGSLGPLLDGTATLRLVKRQVP (PMEL_HUMAN)
  Core: LRLVKRQVP
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLLDGTATXRLXKXQVX

SEQ ID NO: 336904 - protein, 25 aa, Artificial Sequence
  Description of Artificial Sequence: Synthetic peptide
  Seed: SITGSLGPLLDGTATLRLVKRQVPL (PMEL_HUMAN)
  Core: LDGTATLRL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLXDGXAXLRXVKRQVPL

SEQ ID NO: 336905 - protein, 25 aa, Artificial Sequence
  Description of Artificial Sequence: Synthetic peptide
  Seed: SITGSLGPLLDGTATLRLVKRQVPL (PMEL_HUMAN)
  Core: DGTATLRLV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLLXGTXTXRLXKRQVPL

SEQ ID NO: 336906 - protein, 25 aa, Artificial Sequence
  Description of Artificial Sequence: Synthetic peptide
  Seed: SITGSLGPLLDGTATLRLVKRQVPL (PMEL_HUMAN)
  Core: LRLVKRQVP
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SITGSLGPLLDGTATXRLXKXQVXL

SEQ ID NO: 336907 - protein, 13 aa, Artificial Sequence
  Description of Artificial Sequence: Synthetic peptide
  Seed: SIVVLSGTTAAQV (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQV

SEQ ID NO: 336908 - protein, 13 aa, Artificial Sequence
  Description of Artificial Sequence: Synthetic peptide
  Seed: SIVVLSGTTAAQV (PMEL_HUMAN)
  Core: VVLSGTTAA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SIXVLXGXTAXQV

SEQ ID NO: 336909 - protein, 13 aa, Artificial Sequence
  Description of Artificial Sequence: Synthetic peptide
  Seed: SIVVLSGTTAAQV (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXV

SEQ ID NO: 336910 - protein, 13 aa, Artificial Sequence
  Description of Artificial Sequence: Synthetic peptide
  Seed: SIVVLSGTTAAQV (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQX

SEQ ID NO: 336911 - protein, 14 aa, Artificial Sequence
  Description of Artificial Sequence: Synthetic peptide
  Seed: SIVVLSGTTAAQVT (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVT

SEQ ID NO: 336912 - protein, 14 aa, Artificial Sequence
  Description of Artificial Sequence: Synthetic peptide
  Seed: SIVVLSGTTAAQVT (PMEL_HUMAN)
  Core: VVLSGTTAA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SIXVLXGXTAXQVT

SEQ ID NO: 336913 - protein, 14 aa, Artificial Sequence
  Description of Artificial Sequence: Synthetic peptide
  Seed: SIVVLSGTTAAQVT (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVT

SEQ ID NO: 336914 - protein, 14 aa, Artificial Sequence
  Description of Artificial Sequence: Synthetic peptide
  Seed: SIVVLSGTTAAQVT (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXT

SEQ ID NO: 336915 - protein, 15 aa, Artificial Sequence
  Description of Artificial Sequence: Synthetic peptide
  Seed: SIVVLSGTTAAQVTT (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVTT

SEQ ID NO: 336916 - protein, 15 aa, Artificial Sequence
  Description of Artificial Sequence: Synthetic peptide
  Seed: SIVVLSGTTAAQVTT (PMEL_HUMAN)
  Core: VVLSGTTAA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SIXVLXGXTAXQVTT

SEQ ID NO: 336917 - protein, 15 aa, Artificial Sequence
  Description of Artificial Sequence: Synthetic peptide
  Seed: SIVVLSGTTAAQVTT (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTT

SEQ ID NO: 336918 - protein, 15 aa, Artificial Sequence
  Description of Artificial Sequence: Synthetic peptide
  Seed: SIVVLSGTTAAQVTT (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTT

SEQ ID NO: 336919 - protein, 16 aa, Artificial Sequence
  Description of Artificial Sequence: Synthetic peptide
  Seed: SIVVLSGTTAAQVTTT (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVTTT

SEQ ID NO: 336920 - protein, 16 aa, Artificial Sequence
  Description of Artificial Sequence: Synthetic peptide
  Seed: SIVVLSGTTAAQVTTT (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTT

SEQ ID NO: 336921 - protein, 16 aa, Artificial Sequence
  Description of Artificial Sequence: Synthetic peptide
  Seed: SIVVLSGTTAAQVTTT (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTT

SEQ ID NO: 336922 - protein, 17 aa, Artificial Sequence
  Description of Artificial Sequence: Synthetic peptide
  Seed: SIVVLSGTTAAQVTTTE (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVTTTE

SEQ ID NO: 336923 - protein, 17 aa, Artificial Sequence
  Description of Artificial Sequence: Synthetic peptide
  Seed: SIVVLSGTTAAQVTTTE (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTTE

SEQ ID NO: 336924 - protein, 17 aa, Artificial Sequence
  Description of Artificial Sequence: Synthetic peptide
  Seed: SIVVLSGTTAAQVTTTE (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTTE

SEQ ID NO: 336925 - protein, 17 aa, Artificial Sequence
  Description of Artificial Sequence: Synthetic peptide
  Seed: SIVVLSGTTAAQVTTTE (PMEL_HUMAN)
  Core: TTAAQVTTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGXTAXQXTTXE

SEQ ID NO: 336926 - protein, 18 aa, Artificial Sequence
  Description of Artificial Sequence: Synthetic peptide
  Seed: SIVVLSGTTAAQVTTTEW (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVTTTEW

SEQ ID NO: 336927 - protein, 18 aa, Artificial Sequence
  Description of Artificial Sequence: Synthetic peptide
  Seed: SIVVLSGTTAAQVTTTEW (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTTEW

SEQ ID NO: 336928 - protein, 18 aa, Artificial Sequence
  Description of Artificial Sequence: Synthetic peptide
  Seed: SIVVLSGTTAAQVTTTEW (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTTEW

SEQ ID NO: 336929 - protein, 18 aa, Artificial Sequence
  Description of Artificial Sequence: Synthetic peptide
  Seed: SIVVLSGTTAAQVTTTEW (PMEL_HUMAN)
  Core: TTAAQVTTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGXTAXQXTTXEW

SEQ ID NO: 336930 - protein, 19 aa, Artificial Sequence
  Description of Artificial Sequence: Synthetic peptide
  Seed: SIVVLSGTTAAQVTTTEWV (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVTTTEWV

SEQ ID NO: 336931 - protein, 19 aa, Artificial Sequence
  Description of Artificial Sequence: Synthetic peptide
  Seed: SIVVLSGTTAAQVTTTEWV (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTTEWV

SEQ ID NO: 336932 - protein, 19 aa, Artificial Sequence
  Description of Artificial Sequence: Synthetic peptide
  Seed: SIVVLSGTTAAQVTTTEWV (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTTEWV

SEQ ID NO: 336933 - protein, 19 aa, Artificial Sequence
  Description of Artificial Sequence: Synthetic peptide
  Seed: SIVVLSGTTAAQVTTTEWV (PMEL_HUMAN)
  Core: TTAAQVTTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGXTAXQXTTXEWV

SEQ ID NO: 336934 - protein, 20 aa, Artificial Sequence
  Description of Artificial Sequence: Synthetic peptide
  Seed: SIVVLSGTTAAQVTTTEWVE (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVTTTEWVE

SEQ ID NO: 336935 - protein, 20 aa, Artificial Sequence
  Description of Artificial Sequence: Synthetic peptide
  Seed: SIVVLSGTTAAQVTTTEWVE (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTTEWVE

SEQ ID NO: 336936 - protein, 20 aa, Artificial Sequence
  Description of Artificial Sequence: Synthetic peptide
  Seed: SIVVLSGTTAAQVTTTEWVE (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTTEWVE

SEQ ID NO: 336937 - protein, 20 aa, Artificial Sequence
  Description of Artificial Sequence: Synthetic peptide
  Seed: SIVVLSGTTAAQVTTTEWVE (PMEL_HUMAN)
  Core: TTAAQVTTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGXTAXQXTTXEWVE

SEQ ID NO: 336938 - protein, 21 aa, Artificial Sequence
  Description of Artificial Sequence: Synthetic peptide
  Seed: SIVVLSGTTAAQVTTTEWVET (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTTEWVET

SEQ ID NO: 336939 - protein, 21 aa, Artificial Sequence
  Description of Artificial Sequence: Synthetic peptide
  Seed: SIVVLSGTTAAQVTTTEWVET (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTTEWVET

SEQ ID NO: 336940 - protein, 21 aa, Artificial Sequence
  Description of Artificial Sequence: Synthetic peptide
  Seed: SIVVLSGTTAAQVTTTEWVET (PMEL_HUMAN)
  Core: TTAAQVTTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGXTAXQXTTXEWVET

SEQ ID NO: 336941 - protein, 22 aa, Artificial Sequence
  Description of Artificial Sequence: Synthetic peptide
  Seed: SIVVLSGTTAAQVTTTEWVETT (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTTEWVETT

SEQ ID NO: 336942 - protein, 22 aa, Artificial Sequence
  Description of Artificial Sequence: Synthetic peptide
  Seed: SIVVLSGTTAAQVTTTEWVETT (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTTEWVETT

SEQ ID NO: 336943 - protein, 22 aa, Artificial Sequence
  Description of Artificial Sequence: Synthetic peptide
  Seed: SIVVLSGTTAAQVTTTEWVETT (PMEL_HUMAN)
  Core: TTAAQVTTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGXTAXQXTTXEWVETT

SEQ ID NO: 336944 - protein, 22 aa, Artificial Sequence
  Description of Artificial Sequence: Synthetic peptide
  Seed: SIVVLSGTTAAQVTTTEWVETT (PMEL_HUMAN)
  Core: VTTTEWVET
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGTTAAQXTTXEXVEXT

SEQ ID NO: 336945 - protein, 23 aa, Artificial Sequence
  Description of Artificial Sequence: Synthetic peptide
  Seed: SIVVLSGTTAAQVTTTEWVETTA (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVTTTEWVETTA

SEQ ID NO: 336946 - protein, 23 aa, Artificial Sequence
  Description of Artificial Sequence: Synthetic peptide
  Seed: SIVVLSGTTAAQVTTTEWVETTA (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTTEWVETTA

SEQ ID NO: 336947 - protein, 23 aa, Artificial Sequence
  Description of Artificial Sequence: Synthetic peptide
  Seed: SIVVLSGTTAAQVTTTEWVETTA (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTTEWVETTA

SEQ ID NO: 336948 - protein, 23 aa, Artificial Sequence
  Description of Artificial Sequence: Synthetic peptide
  Seed: SIVVLSGTTAAQVTTTEWVETTA (PMEL_HUMAN)
  Core: TTAAQVTTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGXTAXQXTTXEWVETTA

SEQ ID NO: 336949 - protein, 23 aa, Artificial Sequence
  Description of Artificial Sequence: Synthetic peptide
  Seed: SIVVLSGTTAAQVTTTEWVETTA (PMEL_HUMAN)
  Core: QVTTTEWVE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGTTAAXVTXTXWVXTTA

SEQ ID NO: 336950 - protein, 23 aa, Artificial Sequence
  Description of Artificial Sequence: Synthetic peptide
  Seed: SIVVLSGTTAAQVTTTEWVETTA (PMEL_HUMAN)
  Core: VTTTEWVET
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGTTAAQXTTXEXVEXTA

SEQ ID NO: 336951 - protein, 24 aa, Artificial Sequence
  Description of Artificial Sequence: Synthetic peptide
  Seed: SIVVLSGTTAAQVTTTEWVETTAR (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVTTTEWVETTAR

SEQ ID NO: 336952 - protein, 24 aa, Artificial Sequence
  Description of Artificial Sequence: Synthetic peptide
  Seed: SIVVLSGTTAAQVTTTEWVETTAR (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTTEWVETTAR

SEQ ID NO: 336953 - protein, 24 aa, Artificial Sequence
  Description of Artificial Sequence: Synthetic peptide
  Seed: SIVVLSGTTAAQVTTTEWVETTAR (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTTEWVETTAR

SEQ ID NO: 336954 - protein, 24 aa, Artificial Sequence
  Description of Artificial Sequence: Synthetic peptide
  Seed: SIVVLSGTTAAQVTTTEWVETTAR (PMEL_HUMAN)
  Core: TTAAQVTTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGXTAXQXTTXEWVETTAR

SEQ ID NO: 336955 - protein, 24 aa, Artificial Sequence
  Description of Artificial Sequence: Synthetic peptide
  Seed: SIVVLSGTTAAQVTTTEWVETTAR (PMEL_HUMAN)
  Core: QVTTTEWVE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGTTAAXVTXTXWVXTTAR

SEQ ID NO: 336956 - protein, 24 aa, Artificial Sequence
  Description of Artificial Sequence: Synthetic peptide
  Seed: SIVVLSGTTAAQVTTTEWVETTAR (PMEL_HUMAN)
  Core: VTTTEWVET
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGTTAAQXTTXEXVEXTAR

SEQ ID NO: 336957 - protein, 25 aa, Artificial Sequence
  Description of Artificial Sequence: Synthetic peptide
  Seed: SIVVLSGTTAAQVTTTEWVETTARE (PMEL_HUMAN)
  Core: IVVLSGTTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVVXSXTTXAQVTTTEWVETTARE

SEQ ID NO: 336958 - protein, 25 aa, Artificial Sequence
  Description of Artificial Sequence: Synthetic peptide
  Seed: SIVVLSGTTAAQVTTTEWVETTARE (PMEL_HUMAN)
  Core: VLSGTTAAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SIVXLSXTXAAXVTTTEWVETTARE

SEQ ID NO: 336959 - protein, 25 aa, Artificial Sequence
  Description of Artificial Sequence: Synthetic peptide
  Seed: SIVVLSGTTAAQVTTTEWVETTARE (PMEL_HUMAN)
  Core: LSGTTAAQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SIVVXSGXTXAQXTTTEWVETTARE

SEQ ID NO: 336960 - protein, 25 aa, Artificial Sequence
  Description of Artificial Sequence: Synthetic peptide
  Seed: SIVVLSGTTAAQVTTTEWVETTARE (PMEL_HUMAN)
  Core: TTAAQVTTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGXTAXQXTTXEWVETTARE

SEQ ID NO: 336961 - protein, 25 aa, Artificial Sequence
  Description of Artificial Sequence: Synthetic peptide
  Seed: SIVVLSGTTAAQVTTTEWVETTARE (PMEL_HUMAN)
  Core: QVTTTEWVE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGTTAAXVTXTXWVXTTARE

SEQ ID NO: 336962 - protein, 25 aa, Artificial Sequence
  Description of Artificial Sequence: Synthetic peptide
  Seed: SIVVLSGTTAAQVTTTEWVETTARE (PMEL_HUMAN)
  Core: VTTTEWVET
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGTTAAQXTTXEXVEXTARE

SEQ ID NO: 336963 - protein, 25 aa, Artificial Sequence
  Description of Artificial Sequence: Synthetic peptide
  Seed: SIVVLSGTTAAQVTTTEWVETTARE (PMEL_HUMAN)
  Core: TTEWVETTA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SIVVLSGTTAAQVTXTEXVXTTXRE

SEQ ID NO: 336964 - protein, 14 aa, Artificial Sequence
  Description of Artificial Sequence: Synthetic peptide
  Seed: SLADTNSLAVVSTQ (PMEL_HUMAN)
  Core: DTNSLAVVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXTNXLXVVXTQ

SEQ ID NO: 336965 - protein, 14 aa, Artificial Sequence
  Description of Artificial Sequence: Synthetic peptide
  Seed: SLADTNSLAVVSTQ (PMEL_HUMAN)
  Core: TNSLAVVST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLADXNSXAXVSXQ

SEQ ID NO: 336966 - protein, 14 aa, Artificial Sequence
  Description of Artificial Sequence: Synthetic peptide
  Seed: SLADTNSLAVVSTQ (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTX

SEQ ID NO: 336967 - protein, 15 aa, Artificial Sequence
  Description of Artificial Sequence: Synthetic peptide
  Seed: SLADTNSLAVVSTQL (PMEL_HUMAN)
  Core: LADTNSLAV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXADXNXLAXVSTQL

SEQ ID NO: 336968 - protein, 15 aa, Artificial Sequence
  Description of Artificial Sequence: Synthetic peptide
  Seed: SLADTNSLAVVSTQL (PMEL_HUMAN)
  Core: DTNSLAVVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXTNXLXVVXTQL

SEQ ID NO: 336969 - protein, 15 aa, Artificial Sequence
  Description of Artificial Sequence: Synthetic peptide
  Seed: SLADTNSLAVVSTQL (PMEL_HUMAN)
  Core: TNSLAVVST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLADXNSXAXVSXQL

SEQ ID NO: 336970 - protein, 15 aa, Artificial Sequence
  Description of Artificial Sequence: Synthetic peptide
  Seed: SLADTNSLAVVSTQL (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXL

SEQ ID NO: 336971 - protein, 16 aa, Artificial Sequence
  Description of Artificial Sequence: Synthetic peptide
  Seed: SLADTNSLAVVSTQLI (PMEL_HUMAN)
  Core: LADTNSLAV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXADXNXLAXVSTQLI

SEQ ID NO: 336972 - protein, 16 aa, Artificial Sequence
  Description of Artificial Sequence: Synthetic peptide
  Seed: SLADTNSLAVVSTQLI (PMEL_HUMAN)
  Core: ADTNSLAVV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SLXDTXSXAVXSTQLI

SEQ ID NO: 336973 - protein, 16 aa, Artificial Sequence
  Description of Artificial Sequence: Synthetic peptide
  Seed: SLADTNSLAVVSTQLI (PMEL_HUMAN)
  Core: DTNSLAVVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXTNXLXVVXTQLI

SEQ ID NO: 336974 - protein, 16 aa, Artificial Sequence
  Description of Artificial Sequence: Synthetic peptide
  Seed: SLADTNSLAVVSTQLI (PMEL_HUMAN)
  Core: TNSLAVVST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLADXNSXAXVSXQLI

SEQ ID NO: 336975 - protein, 16 aa, Artificial Sequence
  Description of Artificial Sequence: Synthetic peptide
  Seed: SLADTNSLAVVSTQLI (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLI

SEQ ID NO: 336976 - protein, 16 aa, Artificial Sequence
  Description of Artificial Sequence: Synthetic peptide
  Seed: SLADTNSLAVVSTQLI (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLX

SEQ ID NO: 336977 - protein, 17 aa, Artificial Sequence
  Description of Artificial Sequence: Synthetic peptide
  Seed: SLADTNSLAVVSTQLIM (PMEL_HUMAN)
  Core: DTNSLAVVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXTNXLXVVXTQLIM

SEQ ID NO: 336978 - protein, 17 aa, Artificial Sequence
  Description of Artificial Sequence: Synthetic peptide
  Seed: SLADTNSLAVVSTQLIM (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLIM

SEQ ID NO: 336979 - protein, 17 aa, Artificial Sequence
  Description of Artificial Sequence: Synthetic peptide
  Seed: SLADTNSLAVVSTQLIM (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLXM

SEQ ID NO: 336980 - protein, 18 aa, Artificial Sequence
  Description of Artificial Sequence: Synthetic peptide
  Seed: SLADTNSLAVVSTQLIMP (PMEL_HUMAN)
  Core: DTNSLAVVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXTNXLXVVXTQLIMP

SEQ ID NO: 336981 - protein, 18 aa, Artificial Sequence
  Description of Artificial Sequence: Synthetic peptide
  Seed: SLADTNSLAVVSTQLIMP (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLIMP

SEQ ID NO: 336982 - protein, 18 aa, Artificial Sequence
  Description of Artificial Sequence: Synthetic peptide
  Seed: SLADTNSLAVVSTQLIMP (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLXMP

SEQ ID NO: 336983 - protein, 19 aa, Artificial Sequence
  Description of Artificial Sequence: Synthetic peptide
  Seed: SLADTNSLAVVSTQLIMPG (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLIMPG

SEQ ID NO: 336984 - protein, 19 aa, Artificial Sequence
  Description of Artificial Sequence: Synthetic peptide
  Seed: SLADTNSLAVVSTQLIMPG (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLXMPG

SEQ ID NO: 336985 - protein, 20 aa, Artificial Sequence
  Description of Artificial Sequence: Synthetic peptide
  Seed: SLADTNSLAVVSTQLIMPGQ (PMEL_HUMAN)
  Core: DTNSLAVVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXTNXLXVVXTQLIMPGQ

SEQ ID NO: 336986 - protein, 20 aa, Artificial Sequence
  Description of Artificial Sequence: Synthetic peptide
  Seed: SLADTNSLAVVSTQLIMPGQ (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLIMPGQ

SEQ ID NO: 336987 - protein, 20 aa, Artificial Sequence
  Description of Artificial Sequence: Synthetic peptide
  Seed: SLADTNSLAVVSTQLIMPGQ (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLXMPGQ

SEQ ID NO: 336988 - protein, 20 aa, Artificial Sequence
  Description of Artificial Sequence: Synthetic peptide
  Seed: SLADTNSLAVVSTQLIMPGQ (PMEL_HUMAN)
  Core: VSTQLIMPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAVXSTXLXMPXQ

SEQ ID NO: 336989 - protein, 21 aa, Artificial Sequence
  Description of Artificial Sequence: Synthetic peptide
  Seed: SLADTNSLAVVSTQLIMPGQE (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLIMPGQE

SEQ ID NO: 336990 - protein, 21 aa, Artificial Sequence
  Description of Artificial Sequence: Synthetic peptide
  Seed: SLADTNSLAVVSTQLIMPGQE (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLXMPGQE

SEQ ID NO: 336991 - protein, 21 aa, Artificial Sequence
  Description of Artificial Sequence: Synthetic peptide
  Seed: SLADTNSLAVVSTQLIMPGQE (PMEL_HUMAN)
  Core: VVSTQLIMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAXVSXQXIMXGQE

SEQ ID NO: 336992 - protein, 21 aa, Artificial Sequence
  Description of Artificial Sequence: Synthetic peptide
  Seed: SLADTNSLAVVSTQLIMPGQE (PMEL_HUMAN)
  Core: VSTQLIMPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAVXSTXLXMPXQE

SEQ ID NO: 336993 - protein, 22 aa, Artificial Sequence
  Description of Artificial Sequence: Synthetic peptide
  Seed: SLADTNSLAVVSTQLIMPGQEA (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLIMPGQEA

SEQ ID NO: 336994 - protein, 22 aa, Artificial Sequence
  Description of Artificial Sequence: Synthetic peptide
  Seed: SLADTNSLAVVSTQLIMPGQEA (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLXMPGQEA

SEQ ID NO: 336995 - protein, 22 aa, Artificial Sequence
  Description of Artificial Sequence: Synthetic peptide
  Seed: SLADTNSLAVVSTQLIMPGQEA (PMEL_HUMAN)
  Core: VVSTQLIMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAXVSXQXIMXGQEA

SEQ ID NO: 336996 - protein, 22 aa, Artificial Sequence
  Description of Artificial Sequence: Synthetic peptide
  Seed: SLADTNSLAVVSTQLIMPGQEA (PMEL_HUMAN)
  Core: VSTQLIMPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAVXSTXLXMPXQEA

SEQ ID NO: 336997 - protein, 23 aa, Artificial Sequence
  Description of Artificial Sequence: Synthetic peptide
  Seed: SLADTNSLAVVSTQLIMPGQEAG (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLIMPGQEAG

SEQ ID NO: 336998 - protein, 23 aa, Artificial Sequence
  Description of Artificial Sequence: Synthetic peptide
  Seed: SLADTNSLAVVSTQLIMPGQEAG (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLXMPGQEAG

SEQ ID NO: 336999 - protein, 23 aa, Artificial Sequence
  Description of Artificial Sequence: Synthetic peptide
  Seed: SLADTNSLAVVSTQLIMPGQEAG (PMEL_HUMAN)
  Core: VVSTQLIMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAXVSXQXIMXGQEAG

SEQ ID NO: 337000 - protein, 23 aa, Artificial Sequence
  Description of Artificial Sequence: Synthetic peptide
  Seed: SLADTNSLAVVSTQLIMPGQEAG (PMEL_HUMAN)
  Core: VSTQLIMPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAVXSTXLXMPXQEAG

SEQ ID NO: 337001 - protein, 24 aa, Artificial Sequence
  Description of Artificial Sequence: Synthetic peptide
  Seed: SLADTNSLAVVSTQLIMPGQEAGL (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLIMPGQEAGL

SEQ ID NO: 337002 - protein, 24 aa, Artificial Sequence
  Description of Artificial Sequence: Synthetic peptide
  Seed: SLADTNSLAVVSTQLIMPGQEAGL (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLXMPGQEAGL

SEQ ID NO: 337003 - protein, 24 aa, Artificial Sequence
  Description of Artificial Sequence: Synthetic peptide
  Seed: SLADTNSLAVVSTQLIMPGQEAGL (PMEL_HUMAN)
  Core: VVSTQLIMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAXVSXQXIMXGQEAGL

SEQ ID NO: 337004 - protein, 24 aa, Artificial Sequence
  Description of Artificial Sequence: Synthetic peptide
  Seed: SLADTNSLAVVSTQLIMPGQEAGL (PMEL_HUMAN)
  Core: VSTQLIMPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAVXSTXLXMPXQEAGL

SEQ ID NO: 337005 - protein, 24 aa, Artificial Sequence
  Description of Artificial Sequence: Synthetic peptide
  Seed: SLADTNSLAVVSTQLIMPGQEAGL (PMEL_HUMAN)
  Core: QLIMPGQEA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAVVSTXLIXPXQEXGL

SEQ ID NO: 337006 - protein, 25 aa, Artificial Sequence
  Description of Artificial Sequence: Synthetic peptide
  Seed: SLADTNSLAVVSTQLIMPGQEAGLG (PMEL_HUMAN)
  Core: NSLAVVSTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLADTXSLXVXSTXLIMPGQEAGLG

SEQ ID NO: 337007 - protein, 25 aa, Artificial Sequence
  Description of Artificial Sequence: Synthetic peptide
  Seed: SLADTNSLAVVSTQLIMPGQEAGLG (PMEL_HUMAN)
  Core: LAVVSTQLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSXAVXSXQLXMPGQEAGLG

SEQ ID NO: 337008 - protein, 25 aa, Artificial Sequence
  Description of Artificial Sequence: Synthetic peptide
  Seed: SLADTNSLAVVSTQLIMPGQEAGLG (PMEL_HUMAN)
  Core: VVSTQLIMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAXVSXQXIMXGQEAGLG

SEQ ID NO: 337009 - protein, 25 aa, Artificial Sequence
  Description of Artificial Sequence: Synthetic peptide
  Seed: SLADTNSLAVVSTQLIMPGQEAGLG (PMEL_HUMAN)
  Core: VSTQLIMPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAVXSTXLXMPXQEAGLG

SEQ ID NO: 337010 - protein, 25 aa, Artificial Sequence
  Description of Artificial Sequence: Synthetic peptide
  Seed: SLADTNSLAVVSTQLIMPGQEAGLG (PMEL_HUMAN)
  Core: QLIMPGQEA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SLADTNSLAVVSTXLIXPXQEXGLG

SEQ ID NO: 337011 - protein, 13 aa, Artificial Sequence
  Description of Artificial Sequence: Synthetic peptide
  Seed: SLAVVSTQLIMPG (PMEL_HUMAN)
  Core: LAVVSTQLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXAVXSXQLXMPG

SEQ ID NO: 337012 - protein, 13 aa, Artificial Sequence
  Description of Artificial Sequence: Synthetic peptide
  Seed: SLAVVSTQLIMPG (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXG

SEQ ID NO: 337013 - protein, 14 aa, Artificial Sequence
  Description of Artificial Sequence: Synthetic peptide
  Seed: SLAVVSTQLIMPGQ (PMEL_HUMAN)
  Core: LAVVSTQLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXAVXSXQLXMPGQ

SEQ ID NO: 337014 - protein, 14 aa, Artificial Sequence
  Description of Artificial Sequence: Synthetic peptide
  Seed: SLAVVSTQLIMPGQ (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQ

SEQ ID NO: 337015 - protein, 14 aa, Artificial Sequence
  Description of Artificial Sequence: Synthetic peptide
  Seed: SLAVVSTQLIMPGQ (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQ

SEQ ID NO: 337016 - protein, 15 aa, Artificial Sequence
  Description of Artificial Sequence: Synthetic peptide
  Seed: SLAVVSTQLIMPGQE (PMEL_HUMAN)
  Core: LAVVSTQLI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXAVXSXQLXMPGQE

SEQ ID NO: 337017 - protein, 15 aa, Artificial Sequence
  Description of Artificial Sequence: Synthetic peptide
  Seed: SLAVVSTQLIMPGQE (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQE

SEQ ID NO: 337018 - protein, 15 aa, Artificial Sequence
  Description of Artificial Sequence: Synthetic peptide
  Seed: SLAVVSTQLIMPGQE (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQE

SEQ ID NO: 337019 - protein, 16 aa, Artificial Sequence
  Description of Artificial Sequence: Synthetic peptide
  Seed: SLAVVSTQLIMPGQEA (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEA

SEQ ID NO: 337020 - protein, 16 aa, Artificial Sequence
  Description of Artificial Sequence: Synthetic peptide
  Seed: SLAVVSTQLIMPGQEA (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEA

SEQ ID NO: 337021 - protein, 17 aa, Artificial Sequence
  Description of Artificial Sequence: Synthetic peptide
  Seed: SLAVVSTQLIMPGQEAG (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEAG

SEQ ID NO: 337022 - protein, 17 aa, Artificial Sequence
  Description of Artificial Sequence: Synthetic peptide
  Seed: SLAVVSTQLIMPGQEAG (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEAG

SEQ ID NO: 337023 - protein, 17 aa, Artificial Sequence
  Description of Artificial Sequence: Synthetic peptide
  Seed: SLAVVSTQLIMPGQEAG (PMEL_HUMAN)
  Core: QLIMPGQEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTXLIXPXQEXG

SEQ ID NO: 337024 - protein, 18 aa, Artificial Sequence
  Description of Artificial Sequence: Synthetic peptide
  Seed: SLAVVSTQLIMPGQEAGL (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEAGL

SEQ ID NO: 337025 - protein, 18 aa, Artificial Sequence
  Description of Artificial Sequence: Synthetic peptide
  Seed: SLAVVSTQLIMPGQEAGL (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEAGL

SEQ ID NO: 337026 - protein, 19 aa, Artificial Sequence
  Description of Artificial Sequence: Synthetic peptide
  Seed: SLAVVSTQLIMPGQEAGLG (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEAGLG

SEQ ID NO: 337027 - protein, 19 aa, Artificial Sequence
  Description of Artificial Sequence: Synthetic peptide
  Seed: SLAVVSTQLIMPGQEAGLG (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEAGLG

SEQ ID NO: 337028 - protein, 19 aa, Artificial Sequence
  Description of Artificial Sequence: Synthetic peptide
  Seed: SLAVVSTQLIMPGQEAGLG (PMEL_HUMAN)
  Core: QLIMPGQEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTXLIXPXQEXGLG

SEQ ID NO: 337029 - protein, 20 aa, Artificial Sequence
  Description of Artificial Sequence: Synthetic peptide
  Seed: SLAVVSTQLIMPGQEAGLGQ (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEAGLGQ

SEQ ID NO: 337030 - protein, 20 aa, Artificial Sequence
  Description of Artificial Sequence: Synthetic peptide
  Seed: SLAVVSTQLIMPGQEAGLGQ (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEAGLGQ

SEQ ID NO: 337031 - protein, 20 aa, Artificial Sequence
  Description of Artificial Sequence: Synthetic peptide
  Seed: SLAVVSTQLIMPGQEAGLGQ (PMEL_HUMAN)
  Core: QLIMPGQEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTXLIXPXQEXGLGQ

SEQ ID NO: 337032 - protein, 20 aa, Artificial Sequence
  Description of Artificial Sequence: Synthetic peptide
  Seed: SLAVVSTQLIMPGQEAGLGQ (PMEL_HUMAN)
  Core: IMPGQEAGL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTQLXMPXQXAGXGQ

SEQ ID NO: 337033 - protein, 21 aa, Artificial Sequence
  Description of Artificial Sequence: Synthetic peptide
  Seed: SLAVVSTQLIMPGQEAGLGQV (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEAGLGQV

SEQ ID NO: 337034 - protein, 21 aa, Artificial Sequence
  Description of Artificial Sequence: Synthetic peptide
  Seed: SLAVVSTQLIMPGQEAGLGQV (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEAGLGQV

SEQ ID NO: 337035 - protein, 21 aa, Artificial Sequence
  Description of Artificial Sequence: Synthetic peptide
  Seed: SLAVVSTQLIMPGQEAGLGQV (PMEL_HUMAN)
  Core: QLIMPGQEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTXLIXPXQEXGLGQV

SEQ ID NO: 337036 - protein, 22 aa, Artificial Sequence
  Description of Artificial Sequence: Synthetic peptide
  Seed: SLAVVSTQLIMPGQEAGLGQVP (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEAGLGQVP

SEQ ID NO: 337037 - protein, 22 aa, Artificial Sequence
  Description of Artificial Sequence: Synthetic peptide
  Seed: SLAVVSTQLIMPGQEAGLGQVP (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEAGLGQVP

SEQ ID NO: 337038 - protein, 22 aa, Artificial Sequence
  Description of Artificial Sequence: Synthetic peptide
  Seed: SLAVVSTQLIMPGQEAGLGQVP (PMEL_HUMAN)
  Core: QLIMPGQEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTXLIXPXQEXGLGQVP

SEQ ID NO: 337039 - protein, 23 aa, Artificial Sequence
  Description of Artificial Sequence: Synthetic peptide
  Seed: SLAVVSTQLIMPGQEAGLGQVPL (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEAGLGQVPL

SEQ ID NO: 337040 - protein, 23 aa, Artificial Sequence
  Description of Artificial Sequence: Synthetic peptide
  Seed: SLAVVSTQLIMPGQEAGLGQVPL (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEAGLGQVPL

SEQ ID NO: 337041 - protein, 23 aa, Artificial Sequence
  Description of Artificial Sequence: Synthetic peptide
  Seed: SLAVVSTQLIMPGQEAGLGQVPL (PMEL_HUMAN)
  Core: QLIMPGQEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTXLIXPXQEXGLGQVPL

SEQ ID NO: 337042 - protein, 24 aa, Artificial Sequence
  Description of Artificial Sequence: Synthetic peptide
  Seed: SLAVVSTQLIMPGQEAGLGQVPLI (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEAGLGQVPLI

SEQ ID NO: 337043 - protein, 24 aa, Artificial Sequence
  Description of Artificial Sequence: Synthetic peptide
  Seed: SLAVVSTQLIMPGQEAGLGQVPLI (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEAGLGQVPLI

SEQ ID NO: 337044 - protein, 24 aa, Artificial Sequence
  Description of Artificial Sequence: Synthetic peptide
  Seed: SLAVVSTQLIMPGQEAGLGQVPLI (PMEL_HUMAN)
  Core: QLIMPGQEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTXLIXPXQEXGLGQVPLI

SEQ ID NO: 337045 - protein, 24 aa, Artificial Sequence
  Description of Artificial Sequence: Synthetic peptide
  Seed: SLAVVSTQLIMPGQEAGLGQVPLI (PMEL_HUMAN)
  Core: IMPGQEAGL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTQLXMPXQXAGXGQVPLI

SEQ ID NO: 337046 - protein, 25 aa, Artificial Sequence
  Description of Artificial Sequence: Synthetic peptide
  Seed: SLAVVSTQLIMPGQEAGLGQVPLIV (PMEL_HUMAN)
  Core: VVSTQLIMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLAXVSXQXIMXGQEAGLGQVPLIV

SEQ ID NO: 337047 - protein, 25 aa, Artificial Sequence
  Description of Artificial Sequence: Synthetic peptide
  Seed: SLAVVSTQLIMPGQEAGLGQVPLIV (PMEL_HUMAN)
  Core: VSTQLIMPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SLAVXSTXLXMPXQEAGLGQVPLIV

SEQ ID NO: 337048 - protein, 25 aa, Artificial Sequence
  Description of Artificial Sequence: Synthetic peptide
  Seed: SLAVVSTQLIMPGQEAGLGQVPLIV (PMEL_HUMAN)
  Core: QLIMPGQEA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTXLIXPXQEXGLGQVPLIV

SEQ ID NO: 337049 - protein, 25 aa, Artificial Sequence
  Description of Artificial Sequence: Synthetic peptide
  Seed: SLAVVSTQLIMPGQEAGLGQVPLIV (PMEL_HUMAN)
  Core: IMPGQEAGL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLAVVSTQLXMPXQXAGXGQVPLIV

SEQ ID NO: 337050 - protein, 15 aa, Artificial Sequence
  Description of Artificial Sequence: Synthetic peptide
  Seed: SLGPLLDGTATLRLV (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXV

SEQ ID NO: 337051 - protein, 16 aa, Artificial Sequence
  Description of Artificial Sequence: Synthetic peptide
  Seed: SLGPLLDGTATLRLVK (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVK

SEQ ID NO: 337052 - protein, 17 aa, Artificial Sequence
  Description of Artificial Sequence: Synthetic peptide
  Seed: SLGPLLDGTATLRLVKR (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVKR

SEQ ID NO: 337053 - protein, 18 aa, Artificial Sequence
  Description of Artificial Sequence: Synthetic peptide
  Seed: SLGPLLDGTATLRLVKRQ (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVKRQ

SEQ ID NO: 337054 - protein, 18 aa, Artificial Sequence
  Description of Artificial Sequence: Synthetic peptide
  Seed: SLGPLLDGTATLRLVKRQ (PMEL_HUMAN)
  Core: DGTATLRLV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLXGTXTXRLXKRQ

SEQ ID NO: 337055 - protein, 19 aa, Artificial Sequence
  Description of Artificial Sequence: Synthetic peptide
  Seed: SLGPLLDGTATLRLVKRQV (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVKRQV

SEQ ID NO: 337056 - protein, 19 aa, Artificial Sequence
  Description of Artificial Sequence: Synthetic peptide
  Seed: SLGPLLDGTATLRLVKRQV (PMEL_HUMAN)
  Core: DGTATLRLV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLXGTXTXRLXKRQV

SEQ ID NO: 337057 - protein, 20 aa, Artificial Sequence
  Description of Artificial Sequence: Synthetic peptide
  Seed: SLGPLLDGTATLRLVKRQVP (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVKRQVP

SEQ ID NO: 337058 - protein, 20 aa, Artificial Sequence
  Description of Artificial Sequence: Synthetic peptide
  Seed: SLGPLLDGTATLRLVKRQVP (PMEL_HUMAN)
  Core: DGTATLRLV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLXGTXTXRLXKRQVP

SEQ ID NO: 337059 - protein, 20 aa, Artificial Sequence
  Description of Artificial Sequence: Synthetic peptide
  Seed: SLGPLLDGTATLRLVKRQVP (PMEL_HUMAN)
  Core: LRLVKRQVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTATXRLXKXQVX

SEQ ID NO: 337060 - protein, 21 aa, Artificial Sequence
  Description of Artificial Sequence: Synthetic peptide
  Seed: SLGPLLDGTATLRLVKRQVPL (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVKRQVPL

SEQ ID NO: 337061 - protein, 21 aa, Artificial Sequence
  Description of Artificial Sequence: Synthetic peptide
  Seed: SLGPLLDGTATLRLVKRQVPL (PMEL_HUMAN)
  Core: DGTATLRLV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLXGTXTXRLXKRQVPL

SEQ ID NO: 337062 - protein, 21 aa, Artificial Sequence
  Description of Artificial Sequence: Synthetic peptide
  Seed: SLGPLLDGTATLRLVKRQVPL (PMEL_HUMAN)
  Core: TATLRLVKR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGXATXRXVKXQVPL

SEQ ID NO: 337063 - protein, 21 aa, Artificial Sequence
  Description of Artificial Sequence: Synthetic peptide
  Seed: SLGPLLDGTATLRLVKRQVPL (PMEL_HUMAN)
  Core: LRLVKRQVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTATXRLXKXQVXL

SEQ ID NO: 337064 - protein, 22 aa, Artificial Sequence
  Description of Artificial Sequence: Synthetic peptide
  Seed: SLGPLLDGTATLRLVKRQVPLD (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVKRQVPLD

SEQ ID NO: 337065 - protein, 22 aa, Artificial Sequence
  Description of Artificial Sequence: Synthetic peptide
  Seed: SLGPLLDGTATLRLVKRQVPLD (PMEL_HUMAN)
  Core: DGTATLRLV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLXGTXTXRLXKRQVPLD

SEQ ID NO: 337066 - protein, 22 aa, Artificial Sequence
  Description of Artificial Sequence: Synthetic peptide
  Seed: SLGPLLDGTATLRLVKRQVPLD (PMEL_HUMAN)
  Core: TATLRLVKR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGXATXRXVKXQVPLD

SEQ ID NO: 337067 - protein, 22 aa, Artificial Sequence
  Description of Artificial Sequence: Synthetic peptide
  Seed: SLGPLLDGTATLRLVKRQVPLD (PMEL_HUMAN)
  Core: TLRLVKRQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTAXLRXVXRQXPLD

SEQ ID NO: 337068 - protein, 22 aa, Artificial Sequence
  Description of Artificial Sequence: Synthetic peptide
  Seed: SLGPLLDGTATLRLVKRQVPLD (PMEL_HUMAN)
  Core: LRLVKRQVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTATXRLXKXQVXLD

SEQ ID NO: 337069 - protein, 23 aa, Artificial Sequence
  Description of Artificial Sequence: Synthetic peptide
  Seed: SLGPLLDGTATLRLVKRQVPLDC (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVKRQVPLDC

SEQ ID NO: 337070 - protein, 23 aa, Artificial Sequence
  Description of Artificial Sequence: Synthetic peptide
  Seed: SLGPLLDGTATLRLVKRQVPLDC (PMEL_HUMAN)
  Core: DGTATLRLV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLXGTXTXRLXKRQVPLDC

SEQ ID NO: 337071 - protein, 23 aa, Artificial Sequence
  Description of Artificial Sequence: Synthetic peptide
  Seed: SLGPLLDGTATLRLVKRQVPLDC (PMEL_HUMAN)
  Core: TATLRLVKR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGXATXRXVKXQVPLDC

SEQ ID NO: 337072 - protein, 23 aa, Artificial Sequence
  Description of Artificial Sequence: Synthetic peptide
  Seed: SLGPLLDGTATLRLVKRQVPLDC (PMEL_HUMAN)
  Core: TLRLVKRQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTAXLRXVXRQXPLDC

SEQ ID NO: 337073 - protein, 23 aa, Artificial Sequence
  Description of Artificial Sequence: Synthetic peptide
  Seed: SLGPLLDGTATLRLVKRQVPLDC (PMEL_HUMAN)
  Core: LRLVKRQVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTATXRLXKXQVXLDC

SEQ ID NO: 337074 - protein, 24 aa, Artificial Sequence
  Description of Artificial Sequence: Synthetic peptide
  Seed: SLGPLLDGTATLRLVKRQVPLDCV (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVKRQVPLDCV

SEQ ID NO: 337075 - protein, 24 aa, Artificial Sequence
  Description of Artificial Sequence: Synthetic peptide
  Seed: SLGPLLDGTATLRLVKRQVPLDCV (PMEL_HUMAN)
  Core: DGTATLRLV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLXGTXTXRLXKRQVPLDCV

SEQ ID NO: 337076 - protein, 24 aa, Artificial Sequence
  Description of Artificial Sequence: Synthetic peptide
  Seed: SLGPLLDGTATLRLVKRQVPLDCV (PMEL_HUMAN)
  Core: TATLRLVKR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGXATXRXVKXQVPLDCV

SEQ ID NO: 337077 - protein, 24 aa, Artificial Sequence
  Description of Artificial Sequence: Synthetic peptide
  Seed: SLGPLLDGTATLRLVKRQVPLDCV (PMEL_HUMAN)
  Core: TLRLVKRQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTAXLRXVXRQXPLDCV

SEQ ID NO: 337078 - protein, 24 aa, Artificial Sequence
  Description of Artificial Sequence: Synthetic peptide
  Seed: SLGPLLDGTATLRLVKRQVPLDCV (PMEL_HUMAN)
  Core: LRLVKRQVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTATXRLXKXQVXLDCV

SEQ ID NO: 337079 - protein, 24 aa, Artificial Sequence
  Description of Artificial Sequence: Synthetic peptide
  Seed: SLGPLLDGTATLRLVKRQVPLDCV (PMEL_HUMAN)
  Core: LVKRQVPLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTATLRXVKXQXPLXCV

SEQ ID NO: 337080 - protein, 25 aa, Artificial Sequence
  Description of Artificial Sequence: Synthetic peptide
  Seed: SLGPLLDGTATLRLVKRQVPLDCVL (PMEL_HUMAN)
  Core: LDGTATLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLXDGXAXLRXVKRQVPLDCVL

SEQ ID NO: 337081 - protein, 25 aa, Artificial Sequence
  Description of Artificial Sequence: Synthetic peptide
  Seed: SLGPLLDGTATLRLVKRQVPLDCVL (PMEL_HUMAN)
  Core: DGTATLRLV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLXGTXTXRLXKRQVPLDCVL

SEQ ID NO: 337082 - protein, 25 aa, Artificial Sequence
  Description of Artificial Sequence: Synthetic peptide
  Seed: SLGPLLDGTATLRLVKRQVPLDCVL (PMEL_HUMAN)
  Core: TATLRLVKR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGXATXRXVKXQVPLDCVL

SEQ ID NO: 337083 - protein, 25 aa, Artificial Sequence
  Description of Artificial Sequence: Synthetic peptide
  Seed: SLGPLLDGTATLRLVKRQVPLDCVL (PMEL_HUMAN)
  Core: TLRLVKRQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTAXLRXVXRQXPLDCVL

SEQ ID NO: 337084 - protein, 25 aa, Artificial Sequence
  Description of Artificial Sequence: Synthetic peptide
  Seed: SLGPLLDGTATLRLVKRQVPLDCVL (PMEL_HUMAN)
  Core: LRLVKRQVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTATXRLXKXQVXLDCVL

SEQ ID NO: 337085 - protein, 25 aa, Artificial Sequence
  Description of Artificial Sequence: Synthetic peptide
  Seed: SLGPLLDGTATLRLVKRQVPLDCVL (PMEL_HUMAN)
  Core: LVKRQVPLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SLGPLLDGTATLRXVKXQXPLXCVL

SEQ ID NO: 337086 - protein, 13 aa, Artificial Sequence
  Description of Artificial Sequence: Synthetic peptide
  Seed: SLIYRRRLMKQDF (PMEL_HUMAN)
  Core: LIYRRRLMK
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXIYXRXLMXQDF

SEQ ID NO: 337087 - protein, 13 aa, Artificial Sequence
  Description of Artificial Sequence: Synthetic peptide
  Seed: SLIYRRRLMKQDF (PMEL_HUMAN)
  Core: IYRRRLMKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SLXYRXRXMKXDF

SEQ ID NO: 337088 - protein, 14 aa, Artificial Sequence
  Description of Artificial Sequence: Synthetic peptide
  Seed: SLIYRRRLMKQDFS (PMEL_HUMAN)
  Core: LIYRRRLMK
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXIYXRXLMXQDFS

SEQ ID NO: 337089 - protein, 14 aa, Artificial Sequence
  Description of Artificial Sequence: Synthetic peptide
  Seed: SLIYRRRLMKQDFS (PMEL_HUMAN)
  Core: IYRRRLMKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SLXYRXRXMKXDFS

SEQ ID NO: 337090 - protein, 15 aa, Artificial Sequence
  Description of Artificial Sequence: Synthetic peptide
  Seed: SLIYRRRLMKQDFSV (PMEL_HUMAN)
  Core: LIYRRRLMK
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXIYXRXLMXQDFSV

SEQ ID NO: 337091 - protein, 15 aa, Artificial Sequence
  Description of Artificial Sequence: Synthetic peptide
  Seed: SLIYRRRLMKQDFSV (PMEL_HUMAN)
  Core: IYRRRLMKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SLXYRXRXMKXDFSV

SEQ ID NO: 337092 - protein, 15 aa, Artificial Sequence
  Description of Artificial Sequence: Synthetic peptide
  Seed: SLIYRRRLMKQDFSV (PMEL_HUMAN)
  Core: YRRRLMKQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLIXRRXLXKQXFSV

SEQ ID NO: 337093 - protein, 15 aa, Artificial Sequence
  Description of Artificial Sequence: Synthetic peptide
  Seed: SLIYRRRLMKQDFSV (PMEL_HUMAN)
  Core: RRLMKQDFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRXRLXKXDFXV

SEQ ID NO: 337094 - protein, 16 aa, Artificial Sequence
  Description of Artificial Sequence: Synthetic peptide
  Seed: SLIYRRRLMKQDFSVP (PMEL_HUMAN)
  Core: LIYRRRLMK
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXIYXRXLMXQDFSVP

SEQ ID NO: 337095 - protein, 16 aa, Artificial Sequence
  Description of Artificial Sequence: Synthetic peptide
  Seed: SLIYRRRLMKQDFSVP (PMEL_HUMAN)
  Core: IYRRRLMKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SLXYRXRXMKXDFSVP

SEQ ID NO: 337096 - protein, 16 aa, Artificial Sequence
  Description of Artificial Sequence: Synthetic peptide
  Seed: SLIYRRRLMKQDFSVP (PMEL_HUMAN)
  Core: YRRRLMKQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLIXRRXLXKQXFSVP

SEQ ID NO: 337097 - protein, 16 aa, Artificial Sequence
  Description of Artificial Sequence: Synthetic peptide
  Seed: SLIYRRRLMKQDFSVP (PMEL_HUMAN)
  Core: RRLMKQDFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRXRLXKXDFXVP

SEQ ID NO: 337098 - protein, 17 aa, Artificial Sequence
  Description of Artificial Sequence: Synthetic peptide
  Seed: SLIYRRRLMKQDFSVPQ (PMEL_HUMAN)
  Core: LIYRRRLMK
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXIYXRXLMXQDFSVPQ

SEQ ID NO: 337099 - protein, 17 aa, Artificial Sequence
  Description of Artificial Sequence: Synthetic peptide
  Seed: SLIYRRRLMKQDFSVPQ (PMEL_HUMAN)
  Core: IYRRRLMKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SLXYRXRXMKXDFSVPQ

SEQ ID NO: 337100 - protein, 17 aa, Artificial Sequence
  Description of Artificial Sequence: Synthetic peptide
  Seed: SLIYRRRLMKQDFSVPQ (PMEL_HUMAN)
  Core: YRRRLMKQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLIXRRXLXKQXFSVPQ

SEQ ID NO: 337101 - protein, 17 aa, Artificial Sequence
  Description of Artificial Sequence: Synthetic peptide
  Seed: SLIYRRRLMKQDFSVPQ (PMEL_HUMAN)
  Core: RRLMKQDFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRXRLXKXDFXVPQ

SEQ ID NO: 337102 - protein, 17 aa, Artificial Sequence
  Description of Artificial Sequence: Synthetic peptide
  Seed: SLIYRRRLMKQDFSVPQ (PMEL_HUMAN)
  Core: RLMKQDFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRXLMXQXFSXPQ

SEQ ID NO: 337103 - protein, 17 aa, Artificial Sequence
  Description of Artificial Sequence: Synthetic peptide
  Seed: SLIYRRRLMKQDFSVPQ (PMEL_HUMAN)
  Core: LMKQDFSVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRXMKXDXSVXQ

SEQ ID NO: 337104 - protein, 17 aa, Artificial Sequence
  Description of Artificial Sequence: Synthetic peptide
  Seed: SLIYRRRLMKQDFSVPQ (PMEL_HUMAN)
  Core: MKQDFSVPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLXKQXFXVPX

SEQ ID NO: 337105 - protein, 18 aa, Artificial Sequence
  Description of Artificial Sequence: Synthetic peptide
  Seed: SLIYRRRLMKQDFSVPQL (PMEL_HUMAN)
  Core: LIYRRRLMK
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXIYXRXLMXQDFSVPQL

SEQ ID NO: 337106 - protein, 18 aa, Artificial Sequence
  Description of Artificial Sequence: Synthetic peptide
  Seed: SLIYRRRLMKQDFSVPQL (PMEL_HUMAN)
  Core: IYRRRLMKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SLXYRXRXMKXDFSVPQL

SEQ ID NO: 337107 - protein, 18 aa, Artificial Sequence
  Description of Artificial Sequence: Synthetic peptide
  Seed: SLIYRRRLMKQDFSVPQL (PMEL_HUMAN)
  Core: YRRRLMKQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLIXRRXLXKQXFSVPQL

SEQ ID NO: 337108 - protein, 18 aa, Artificial Sequence
  Description of Artificial Sequence: Synthetic peptide
  Seed: SLIYRRRLMKQDFSVPQL (PMEL_HUMAN)
  Core: RRLMKQDFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRXRLXKXDFXVPQL

SEQ ID NO: 337109 - protein, 19 aa, Artificial Sequence
  Description of Artificial Sequence: Synthetic peptide
  Seed: SLIYRRRLMKQDFSVPQLP (PMEL_HUMAN)
  Core: IYRRRLMKQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SLXYRXRXMKXDFSVPQLP

SEQ ID NO: 337110 - protein, 19 aa, Artificial Sequence
  Description of Artificial Sequence: Synthetic peptide
  Seed: SLIYRRRLMKQDFSVPQLP (PMEL_HUMAN)
  Core: YRRRLMKQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLIXRRXLXKQXFSVPQLP

SEQ ID NO: 337111 - protein, 19 aa, Artificial Sequence
  Description of Artificial Sequence: Synthetic peptide
  Seed: SLIYRRRLMKQDFSVPQLP (PMEL_HUMAN)
  Core: RRLMKQDFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRXRLXKXDFXVPQLP

SEQ ID NO: 337112 - protein, 19 aa, Artificial Sequence
  Description of Artificial Sequence: Synthetic peptide
  Seed: SLIYRRRLMKQDFSVPQLP (PMEL_HUMAN)
  Core: RLMKQDFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRXLMXQXFSXPQLP

SEQ ID NO: 337113 - protein, 19 aa, Artificial Sequence
  Description of Artificial Sequence: Synthetic peptide
  Seed: SLIYRRRLMKQDFSVPQLP (PMEL_HUMAN)
  Core: LMKQDFSVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRXMKXDXSVXQLP

SEQ ID NO: 337114 - protein, 19 aa, Artificial Sequence
  Description of Artificial Sequence: Synthetic peptide
  Seed: SLIYRRRLMKQDFSVPQLP (PMEL_HUMAN)
  Core: MKQDFSVPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLXKQXFXVPXLP

SEQ ID NO: 337115 - protein, 20 aa, Artificial Sequence
  Description of Artificial Sequence: Synthetic peptide
  Seed: SLIYRRRLMKQDFSVPQLPH (PMEL_HUMAN)
  Core: YRRRLMKQD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLIXRRXLXKQXFSVPQLPH

SEQ ID NO: 337116 - protein, 20 aa, Artificial Sequence
  Description of Artificial Sequence: Synthetic peptide
  Seed: SLIYRRRLMKQDFSVPQLPH (PMEL_HUMAN)
  Core: RRLMKQDFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRXRLXKXDFXVPQLPH

SEQ ID NO: 337117 - protein, 20 aa, Artificial Sequence
  Description of Artificial Sequence: Synthetic peptide
  Seed: SLIYRRRLMKQDFSVPQLPH (PMEL_HUMAN)
  Core: RLMKQDFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRXLMXQXFSXPQLPH

SEQ ID NO: 337118 - protein, 20 aa, Artificial Sequence
  Description of Artificial Sequence: Synthetic peptide
  Seed: SLIYRRRLMKQDFSVPQLPH (PMEL_HUMAN)
  Core: LMKQDFSVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRXMKXDXSVXQLPH

SEQ ID NO: 337119 - protein, 20 aa, Artificial Sequence
  Description of Artificial Sequence: Synthetic peptide
  Seed: SLIYRRRLMKQDFSVPQLPH (PMEL_HUMAN)
  Core: MKQDFSVPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLXKQXFXVPXLPH

SEQ ID NO: 337120 - protein, 21 aa, Artificial Sequence
  Description of Artificial Sequence: Synthetic peptide
  Seed: SLIYRRRLMKQDFSVPQLPHS (PMEL_HUMAN)
  Core: RRLMKQDFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRXRLXKXDFXVPQLPHS

SEQ ID NO: 337121 - protein, 21 aa, Artificial Sequence
  Description of Artificial Sequence: Synthetic peptide
  Seed: SLIYRRRLMKQDFSVPQLPHS (PMEL_HUMAN)
  Core: RLMKQDFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRXLMXQXFSXPQLPHS

SEQ ID NO: 337122 - protein, 21 aa, Artificial Sequence
  Description of Artificial Sequence: Synthetic peptide
  Seed: SLIYRRRLMKQDFSVPQLPHS (PMEL_HUMAN)
  Core: LMKQDFSVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRXMKXDXSVXQLPHS

SEQ ID NO: 337123 - protein, 21 aa, Artificial Sequence
  Description of Artificial Sequence: Synthetic peptide
  Seed: SLIYRRRLMKQDFSVPQLPHS (PMEL_HUMAN)
  Core: MKQDFSVPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLXKQXFXVPXLPHS

SEQ ID NO: 337124 - protein, 21 aa, Artificial Sequence
  Description of Artificial Sequence: Synthetic peptide
  Seed: SLIYRRRLMKQDFSVPQLPHS (PMEL_HUMAN)
  Core: KQDFSVPQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLMXQDXSXPQXPHS

SEQ ID NO: 337125 - protein, 22 aa, Artificial Sequence
  Description of Artificial Sequence: Synthetic peptide
  Seed: SLIYRRRLMKQDFSVPQLPHSS (PMEL_HUMAN)
  Core: RRLMKQDFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRXRLXKXDFXVPQLPHSS

SEQ ID NO: 337126 - protein, 22 aa, Artificial Sequence
  Description of Artificial Sequence: Synthetic peptide
  Seed: SLIYRRRLMKQDFSVPQLPHSS (PMEL_HUMAN)
  Core: RLMKQDFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRXLMXQXFSXPQLPHSS

SEQ ID NO: 337127 - protein, 22 aa, Artificial Sequence
  Description of Artificial Sequence: Synthetic peptide
  Seed: SLIYRRRLMKQDFSVPQLPHSS (PMEL_HUMAN)
  Core: LMKQDFSVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRXMKXDXSVXQLPHSS

SEQ ID NO: 337128 - protein, 22 aa, Artificial Sequence
  Description of Artificial Sequence: Synthetic peptide
  Seed: SLIYRRRLMKQDFSVPQLPHSS (PMEL_HUMAN)
  Core: MKQDFSVPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLXKQXFXVPXLPHSS

SEQ ID NO: 337129 - protein, 22 aa, Artificial Sequence
  Description of Artificial Sequence: Synthetic peptide
  Seed: SLIYRRRLMKQDFSVPQLPHSS (PMEL_HUMAN)
  Core: KQDFSVPQL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLMXQDXSXPQXPHSS

SEQ ID NO: 337130 - protein, 22 aa, Artificial Sequence
  Description of Artificial Sequence: Synthetic peptide
  Seed: SLIYRRRLMKQDFSVPQLPHSS (PMEL_HUMAN)
  Core: FSVPQLPHS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLMKQDXSVXQXPHXS

SEQ ID NO: 337131 - protein, 23 aa, Artificial Sequence
  Description of Artificial Sequence: Synthetic peptide
  Seed: SLIYRRRLMKQDFSVPQLPHSSS (PMEL_HUMAN)
  Core: RRLMKQDFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRXRLXKXDFXVPQLPHSSS

SEQ ID NO: 337132 - protein, 23 aa, Artificial Sequence
  Description of Artificial Sequence: Synthetic peptide
  Seed: SLIYRRRLMKQDFSVPQLPHSSS (PMEL_HUMAN)
  Core: RLMKQDFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRXLMXQXFSXPQLPHSSS

SEQ ID NO: 337133 - protein, 23 aa, Artificial Sequence
  Description of Artificial Sequence: Synthetic peptide
  Seed: SLIYRRRLMKQDFSVPQLPHSSS (PMEL_HUMAN)
  Core: LMKQDFSVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRXMKXDXSVXQLPHSSS

SEQ ID NO: 337134 - protein, 23 aa, Artificial Sequence
  Description of Artificial Sequence: Synthetic peptide
  Seed: SLIYRRRLMKQDFSVPQLPHSSS (PMEL_HUMAN)
  Core: MKQDFSVPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLXKQXFXVPXLPHSSS

SEQ ID NO: 337135 - protein, 23 aa, Artificial Sequence
  Description of Artificial Sequence: Synthetic peptide
  Seed: SLIYRRRLMKQDFSVPQLPHSSS (PMEL_HUMAN)
  Core: FSVPQLPHS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLMKQDXSVXQXPHXSS

SEQ ID NO: 337136 - protein, 24 aa, Artificial Sequence
  Description of Artificial Sequence: Synthetic peptide
  Seed: SLIYRRRLMKQDFSVPQLPHSSSH (PMEL_HUMAN)
  Core: RLMKQDFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRXLMXQXFSXPQLPHSSSH

SEQ ID NO: 337137 - protein, 24 aa, Artificial Sequence
  Description of Artificial Sequence: Synthetic peptide
  Seed: SLIYRRRLMKQDFSVPQLPHSSSH (PMEL_HUMAN)
  Core: LMKQDFSVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRXMKXDXSVXQLPHSSSH

SEQ ID NO: 337138 - protein, 24 aa, Artificial Sequence
  Description of Artificial Sequence: Synthetic peptide
  Seed: SLIYRRRLMKQDFSVPQLPHSSSH (PMEL_HUMAN)
  Core: MKQDFSVPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLXKQXFXVPXLPHSSSH

SEQ ID NO: 337139 - protein, 24 aa, Artificial Sequence
  Description of Artificial Sequence: Synthetic peptide
  Seed: SLIYRRRLMKQDFSVPQLPHSSSH (PMEL_HUMAN)
  Core: FSVPQLPHS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLMKQDXSVXQXPHXSSH

SEQ ID NO: 337140 - protein, 25 aa, Artificial Sequence
  Description of Artificial Sequence: Synthetic peptide
  Seed: SLIYRRRLMKQDFSVPQLPHSSSHW (PMEL_HUMAN)
  Core: RLMKQDFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRXLMXQXFSXPQLPHSSSHW

SEQ ID NO: 337141 - protein, 25 aa, Artificial Sequence
  Description of Artificial Sequence: Synthetic peptide
  Seed: SLIYRRRLMKQDFSVPQLPHSSSHW (PMEL_HUMAN)
  Core: LMKQDFSVP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRXMKXDXSVXQLPHSSSHW

SEQ ID NO: 337142 - protein, 25 aa, Artificial Sequence
  Description of Artificial Sequence: Synthetic peptide
  Seed: SLIYRRRLMKQDFSVPQLPHSSSHW (PMEL_HUMAN)
  Core: MKQDFSVPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLXKQXFXVPXLPHSSSHW

SEQ ID NO: 337143 - protein, 25 aa, Artificial Sequence
  Description of Artificial Sequence: Synthetic peptide
  Seed: SLIYRRRLMKQDFSVPQLPHSSSHW (PMEL_HUMAN)
  Core: FSVPQLPHS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SLIYRRRLMKQDXSVXQXPHXSSHW

SEQ ID NO: 337144 - protein, 15 aa, Artificial Sequence
  Description of Artificial Sequence: Synthetic peptide
  Seed: SLKVSNDGPTLIGAN (PMEL_HUMAN)
  Core: VSNDGPTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SLKXSNXGXTLXGAN

SEQ ID NO: 337145 - protein, 19 aa, Artificial Sequence
  Description of Artificial Sequence: Synthetic peptide
  Seed: SLKVSNDGPTLIGANASFS (PMEL_HUMAN)
  Core: PTLIGANAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGXTLXGXNAXFS

SEQ ID NO: 337146 - protein, 19 aa, Artificial Sequence
  Description of Artificial Sequence: Synthetic peptide
  Seed: SLKVSNDGPTLIGANASFS (PMEL_HUMAN)
  Core: LIGANASFS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTXIGXNXSFX

SEQ ID NO: 337147 - protein, 20 aa, Artificial Sequence
  Description of Artificial Sequence: Synthetic peptide
  Seed: SLKVSNDGPTLIGANASFSI (PMEL_HUMAN)
  Core: NDGPTLIGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSXDGXTXIGXNASFSI

SEQ ID NO: 337148 - protein, 20 aa, Artificial Sequence
  Description of Artificial Sequence: Synthetic peptide
  Seed: SLKVSNDGPTLIGANASFSI (PMEL_HUMAN)
  Core: PTLIGANAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGXTLXGXNAXFSI

SEQ ID NO: 337149 - protein, 20 aa, Artificial Sequence
  Description of Artificial Sequence: Synthetic peptide
  Seed: SLKVSNDGPTLIGANASFSI (PMEL_HUMAN)
  Core: LIGANASFS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTXIGXNXSFXI

SEQ ID NO: 337150 - protein, 20 aa, Artificial Sequence
  Description of Artificial Sequence: Synthetic peptide
  Seed: SLKVSNDGPTLIGANASFSI (PMEL_HUMAN)
  Core: IGANASFSI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTLXGAXAXFSX

SEQ ID NO: 337151 - protein, 21 aa, Artificial Sequence
  Description of Artificial Sequence: Synthetic peptide
  Seed: SLKVSNDGPTLIGANASFSIA (PMEL_HUMAN)
  Core: PTLIGANAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGXTLXGXNAXFSIA

SEQ ID NO: 337152 - protein, 21 aa, Artificial Sequence
  Description of Artificial Sequence: Synthetic peptide
  Seed: SLKVSNDGPTLIGANASFSIA (PMEL_HUMAN)
  Core: LIGANASFS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTXIGXNXSFXIA

SEQ ID NO: 337153 - protein, 21 aa, Artificial Sequence
  Description of Artificial Sequence: Synthetic peptide
  Seed: SLKVSNDGPTLIGANASFSIA (PMEL_HUMAN)
  Core: IGANASFSI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTLXGAXAXFSXA

SEQ ID NO: 337154 - protein, 22 aa, Artificial Sequence
  Description of Artificial Sequence: Synthetic peptide
  Seed: SLKVSNDGPTLIGANASFSIAL (PMEL_HUMAN)
  Core: PTLIGANAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGXTLXGXNAXFSIAL

SEQ ID NO: 337155 - protein, 22 aa, Artificial Sequence
  Description of Artificial Sequence: Synthetic peptide
  Seed: SLKVSNDGPTLIGANASFSIAL (PMEL_HUMAN)
  Core: LIGANASFS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTXIGXNXSFXIAL

SEQ ID NO: 337156 - protein, 22 aa, Artificial Sequence
  Description of Artificial Sequence: Synthetic peptide
  Seed: SLKVSNDGPTLIGANASFSIAL (PMEL_HUMAN)
  Core: IGANASFSI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTLXGAXAXFSXAL

SEQ ID NO: 337157 - protein, 23 aa, Artificial Sequence
  Description of Artificial Sequence: Synthetic peptide
  Seed: SLKVSNDGPTLIGANASFSIALN (PMEL_HUMAN)
  Core: PTLIGANAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGXTLXGXNAXFSIALN

SEQ ID NO: 337158 - protein, 23 aa, Artificial Sequence
  Description of Artificial Sequence: Synthetic peptide
  Seed: SLKVSNDGPTLIGANASFSIALN (PMEL_HUMAN)
  Core: LIGANASFS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTXIGXNXSFXIALN

SEQ ID NO: 337159 - protein, 23 aa, Artificial Sequence
  Description of Artificial Sequence: Synthetic peptide
  Seed: SLKVSNDGPTLIGANASFSIALN (PMEL_HUMAN)
  Core: IGANASFSI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTLXGAXAXFSXALN

SEQ ID NO: 337160 - protein, 24 aa, Artificial Sequence
  Description of Artificial Sequence: Synthetic peptide
  Seed: SLKVSNDGPTLIGANASFSIALNF (PMEL_HUMAN)
  Core: PTLIGANAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGXTLXGXNAXFSIALNF

SEQ ID NO: 337161 - protein, 24 aa, Artificial Sequence
  Description of Artificial Sequence: Synthetic peptide
  Seed: SLKVSNDGPTLIGANASFSIALNF (PMEL_HUMAN)
  Core: LIGANASFS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTXIGXNXSFXIALNF

SEQ ID NO: 337162 - protein, 24 aa, Artificial Sequence
  Description of Artificial Sequence: Synthetic peptide
  Seed: SLKVSNDGPTLIGANASFSIALNF (PMEL_HUMAN)
  Core: IGANASFSI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTLXGAXAXFSXALNF

SEQ ID NO: 337163 - protein, 25 aa, Artificial Sequence
  Description of Artificial Sequence: Synthetic peptide
  Seed: SLKVSNDGPTLIGANASFSIALNFP (PMEL_HUMAN)
  Core: PTLIGANAS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGXTLXGXNAXFSIALNFP

SEQ ID NO: 337164 - protein, 25 aa, Artificial Sequence
  Description of Artificial Sequence: Synthetic peptide
  Seed: SLKVSNDGPTLIGANASFSIALNFP (PMEL_HUMAN)
  Core: LIGANASFS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTXIGXNXSFXIALNFP

SEQ ID NO: 337165 - protein, 25 aa, Artificial Sequence
  Description of Artificial Sequence: Synthetic peptide
  Seed: SLKVSNDGPTLIGANASFSIALNFP (PMEL_HUMAN)
  Core: IGANASFSI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTLXGAXAXFSXALNFP

SEQ ID NO: 337166 - protein, 25 aa, Artificial Sequence
  Description of Artificial Sequence: Synthetic peptide
  Seed: SLKVSNDGPTLIGANASFSIALNFP (PMEL_HUMAN)
  Core: NASFSIALN
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SLKVSNDGPTLIGAXASXSXALXFP

SEQ ID NO: 337167 - protein, 14 aa, Artificial Sequence
  Description of Artificial Sequence: Synthetic peptide
  Seed: SNDGPTLIGANASF (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXF

SEQ ID NO: 337168 - protein, 15 aa, Artificial Sequence
  Description of Artificial Sequence: Synthetic peptide
  Seed: SNDGPTLIGANASFS (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFS

SEQ ID NO: 337169 - protein, 15 aa, Artificial Sequence
  Description of Artificial Sequence: Synthetic peptide
  Seed: SNDGPTLIGANASFS (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFX

SEQ ID NO: 337170 - protein, 16 aa, Artificial Sequence
  Description of Artificial Sequence: Synthetic peptide
  Seed: SNDGPTLIGANASFSI (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSI

SEQ ID NO: 337171 - protein, 16 aa, Artificial Sequence
  Description of Artificial Sequence: Synthetic peptide
  Seed: SNDGPTLIGANASFSI (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXI

SEQ ID NO: 337172 - protein, 16 aa, Artificial Sequence
  Description of Artificial Sequence: Synthetic peptide
  Seed: SNDGPTLIGANASFSI (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSX

SEQ ID NO: 337173 - protein, 17 aa, Artificial Sequence
  Description of Artificial Sequence: Synthetic peptide
  Seed: SNDGPTLIGANASFSIA (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSIA

SEQ ID NO: 337174 - protein, 17 aa, Artificial Sequence
  Description of Artificial Sequence: Synthetic peptide
  Seed: SNDGPTLIGANASFSIA (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXIA

SEQ ID NO: 337175 - protein, 17 aa, Artificial Sequence
  Description of Artificial Sequence: Synthetic peptide
  Seed: SNDGPTLIGANASFSIA (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSXA

SEQ ID NO: 337176 - protein, 18 aa, Artificial Sequence
  Description of Artificial Sequence: Synthetic peptide
  Seed: SNDGPTLIGANASFSIAL (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSIAL

SEQ ID NO: 337177 - protein, 18 aa, Artificial Sequence
  Description of Artificial Sequence: Synthetic peptide
  Seed: SNDGPTLIGANASFSIAL (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXIAL

SEQ ID NO: 337178 - protein, 18 aa, Artificial Sequence
  Description of Artificial Sequence: Synthetic peptide
  Seed: SNDGPTLIGANASFSIAL (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSXAL

SEQ ID NO: 337179 - protein, 19 aa, Artificial Sequence
  Description of Artificial Sequence: Synthetic peptide
  Seed: SNDGPTLIGANASFSIALN (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSIALN

SEQ ID NO: 337180 - protein, 19 aa, Artificial Sequence
  Description of Artificial Sequence: Synthetic peptide
  Seed: SNDGPTLIGANASFSIALN (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXIALN

SEQ ID NO: 337181 - protein, 19 aa, Artificial Sequence
  Description of Artificial Sequence: Synthetic peptide
  Seed: SNDGPTLIGANASFSIALN (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSXALN

SEQ ID NO: 337182 - protein, 20 aa, Artificial Sequence
  Description of Artificial Sequence: Synthetic peptide
  Seed: SNDGPTLIGANASFSIALNF (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSIALNF

SEQ ID NO: 337183 - protein, 20 aa, Artificial Sequence
  Description of Artificial Sequence: Synthetic peptide
  Seed: SNDGPTLIGANASFSIALNF (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXIALNF

SEQ ID NO: 337184 - protein, 20 aa, Artificial Sequence
  Description of Artificial Sequence: Synthetic peptide
  Seed: SNDGPTLIGANASFSIALNF (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSXALNF

SEQ ID NO: 337185 - protein, 20 aa, Artificial Sequence
  Description of Artificial Sequence: Synthetic peptide
  Seed: SNDGPTLIGANASFSIALNF (PMEL_HUMAN)
  Core: NASFSIALN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGAXASXSXALXF

SEQ ID NO: 337186 - protein, 21 aa, Artificial Sequence
  Description of Artificial Sequence: Synthetic peptide
  Seed: SNDGPTLIGANASFSIALNFP (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSIALNFP

SEQ ID NO: 337187 - protein, 21 aa, Artificial Sequence
  Description of Artificial Sequence: Synthetic peptide
  Seed: SNDGPTLIGANASFSIALNFP (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXIALNFP

SEQ ID NO: 337188 - protein, 21 aa, Artificial Sequence
  Description of Artificial Sequence: Synthetic peptide
  Seed: SNDGPTLIGANASFSIALNFP (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSXALNFP

SEQ ID NO: 337189 - protein, 21 aa, Artificial Sequence
  Description of Artificial Sequence: Synthetic peptide
  Seed: SNDGPTLIGANASFSIALNFP (PMEL_HUMAN)
  Core: NASFSIALN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGAXASXSXALXFP

SEQ ID NO: 337190 - protein, 22 aa, Artificial Sequence
  Description of Artificial Sequence: Synthetic peptide
  Seed: SNDGPTLIGANASFSIALNFPG (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSIALNFPG

SEQ ID NO: 337191 - protein, 22 aa, Artificial Sequence
  Description of Artificial Sequence: Synthetic peptide
  Seed: SNDGPTLIGANASFSIALNFPG (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXIALNFPG

SEQ ID NO: 337192 - protein, 22 aa, Artificial Sequence
  Description of Artificial Sequence: Synthetic peptide
  Seed: SNDGPTLIGANASFSIALNFPG (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSXALNFPG

SEQ ID NO: 337193 - protein, 22 aa, Artificial Sequence
  Description of Artificial Sequence: Synthetic peptide
  Seed: SNDGPTLIGANASFSIALNFPG (PMEL_HUMAN)
  Core: NASFSIALN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGAXASXSXALXFPG

SEQ ID NO: 337194 - protein, 22 aa, Artificial Sequence
  Description of Artificial Sequence: Synthetic peptide
  Seed: SNDGPTLIGANASFSIALNFPG (PMEL_HUMAN)
  Core: FSIALNFPG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGANASXSIXLXFPX

SEQ ID NO: 337195 - protein, 23 aa, Artificial Sequence
  Description of Artificial Sequence: Synthetic peptide
  Seed: SNDGPTLIGANASFSIALNFPGS (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSIALNFPGS

SEQ ID NO: 337196 - protein, 23 aa, Artificial Sequence
  Description of Artificial Sequence: Synthetic peptide
  Seed: SNDGPTLIGANASFSIALNFPGS (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXIALNFPGS

SEQ ID NO: 337197 - protein, 23 aa, Artificial Sequence
  Description of Artificial Sequence: Synthetic peptide
  Seed: SNDGPTLIGANASFSIALNFPGS (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSXALNFPGS

SEQ ID NO: 337198 - protein, 23 aa, Artificial Sequence
  Description of Artificial Sequence: Synthetic peptide
  Seed: SNDGPTLIGANASFSIALNFPGS (PMEL_HUMAN)
  Core: NASFSIALN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGAXASXSXALXFPGS

SEQ ID NO: 337199 - protein, 23 aa, Artificial Sequence
  Description of Artificial Sequence: Synthetic peptide
  Seed: SNDGPTLIGANASFSIALNFPGS (PMEL_HUMAN)
  Core: ASFSIALNF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGANXSFXIXLNXPGS

SEQ ID NO: 337200 - protein, 23 aa, Artificial Sequence
  Description of Artificial Sequence: Synthetic peptide
  Seed: SNDGPTLIGANASFSIALNFPGS (PMEL_HUMAN)
  Core: FSIALNFPG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGANASXSIXLXFPXS

SEQ ID NO: 337201 - protein, 24 aa, Artificial Sequence
  Description of Artificial Sequence: Synthetic peptide
  Seed: SNDGPTLIGANASFSIALNFPGSQ (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSIALNFPGSQ

SEQ ID NO: 337202 - protein, 24 aa, Artificial Sequence
  Description of Artificial Sequence: Synthetic peptide
  Seed: SNDGPTLIGANASFSIALNFPGSQ (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXIALNFPGSQ

SEQ ID NO: 337203 - protein, 24 aa, Artificial Sequence
  Description of Artificial Sequence: Synthetic peptide
  Seed: SNDGPTLIGANASFSIALNFPGSQ (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSXALNFPGSQ

SEQ ID NO: 337204 - protein, 24 aa, Artificial Sequence
  Description of Artificial Sequence: Synthetic peptide
  Seed: SNDGPTLIGANASFSIALNFPGSQ (PMEL_HUMAN)
  Core: NASFSIALN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGAXASXSXALXFPGSQ

SEQ ID NO: 337205 - protein, 24 aa, Artificial Sequence
  Description of Artificial Sequence: Synthetic peptide
  Seed: SNDGPTLIGANASFSIALNFPGSQ (PMEL_HUMAN)
  Core: ASFSIALNF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGANXSFXIXLNXPGSQ

SEQ ID NO: 337206 - protein, 24 aa, Artificial Sequence
  Description of Artificial Sequence: Synthetic peptide
  Seed: SNDGPTLIGANASFSIALNFPGSQ (PMEL_HUMAN)
  Core: FSIALNFPG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGANASXSIXLXFPXSQ

SEQ ID NO: 337207 - protein, 25 aa, Artificial Sequence
  Description of Artificial Sequence: Synthetic peptide
  Seed: SNDGPTLIGANASFSIALNFPGSQK (PMEL_HUMAN)
  Core: PTLIGANAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SNDGXTLXGXNAXFSIALNFPGSQK

SEQ ID NO: 337208 - protein, 25 aa, Artificial Sequence
  Description of Artificial Sequence: Synthetic peptide
  Seed: SNDGPTLIGANASFSIALNFPGSQK (PMEL_HUMAN)
  Core: LIGANASFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTXIGXNXSFXIALNFPGSQK

SEQ ID NO: 337209 - protein, 25 aa, Artificial Sequence
  Description of Artificial Sequence: Synthetic peptide
  Seed: SNDGPTLIGANASFSIALNFPGSQK (PMEL_HUMAN)
  Core: IGANASFSI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLXGAXAXFSXALNFPGSQK

SEQ ID NO: 337210 - protein, 25 aa, Artificial Sequence
  Description of Artificial Sequence: Synthetic peptide
  Seed: SNDGPTLIGANASFSIALNFPGSQK (PMEL_HUMAN)
  Core: NASFSIALN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGAXASXSXALXFPGSQK

SEQ ID NO: 337211 - protein, 25 aa, Artificial Sequence
  Description of Artificial Sequence: Synthetic peptide
  Seed: SNDGPTLIGANASFSIALNFPGSQK (PMEL_HUMAN)
  Core: FSIALNFPG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SNDGPTLIGANASXSIXLXFPXSQK

SEQ ID NO: 337212 - protein, 13 aa, Artificial Sequence
  Description of Artificial Sequence: Synthetic peptide
  Seed: SPACQLVLHQILK (PMEL_HUMAN)
  Core: CQLVLHQIL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SPAXQLXLXQIXK

SEQ ID NO: 337213 - protein, 14 aa, Artificial Sequence
  Description of Artificial Sequence: Synthetic peptide
  Seed: SPACQLVLHQILKG (PMEL_HUMAN)
  Core: CQLVLHQIL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SPAXQLXLXQIXKG

SEQ ID NO: 337214 - protein, 14 aa, Artificial Sequence
  Description of Artificial Sequence: Synthetic peptide
  Seed: SPACQLVLHQILKG (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKX

SEQ ID NO: 337215 - protein, 15 aa, Artificial Sequence
  Description of Artificial Sequence: Synthetic peptide
  Seed: SPACQLVLHQILKGG (PMEL_HUMAN)
  Core: CQLVLHQIL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SPAXQLXLXQIXKGG

SEQ ID NO: 337216 - protein, 15 aa, Artificial Sequence
  Description of Artificial Sequence: Synthetic peptide
  Seed: SPACQLVLHQILKGG (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXG

SEQ ID NO: 337217 - protein, 16 aa, Artificial Sequence
  Description of Artificial Sequence: Synthetic peptide
  Seed: SPACQLVLHQILKGGS (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGS

SEQ ID NO: 337218 - protein, 17 aa, Artificial Sequence
  Description of Artificial Sequence: Synthetic peptide
  Seed: SPACQLVLHQILKGGSG (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGSG

SEQ ID NO: 337219 - protein, 17 aa, Artificial Sequence
  Description of Artificial Sequence: Synthetic peptide
  Seed: SPACQLVLHQILKGGSG (PMEL_HUMAN)
  Core: LHQILKGGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVXHQXLXGGXG

SEQ ID NO: 337220 - protein, 18 aa, Artificial Sequence
  Description of Artificial Sequence: Synthetic peptide
  Seed: SPACQLVLHQILKGGSGT (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGSGT

SEQ ID NO: 337221 - protein, 18 aa, Artificial Sequence
  Description of Artificial Sequence: Synthetic peptide
  Seed: SPACQLVLHQILKGGSGT (PMEL_HUMAN)
  Core: LHQILKGGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVXHQXLXGGXGT

SEQ ID NO: 337222 - protein, 19 aa, Artificial Sequence
  Description of Artificial Sequence: Synthetic peptide
  Seed: SPACQLVLHQILKGGSGTY (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGSGTY

SEQ ID NO: 337223 - protein, 19 aa, Artificial Sequence
  Description of Artificial Sequence: Synthetic peptide
  Seed: SPACQLVLHQILKGGSGTY (PMEL_HUMAN)
  Core: LHQILKGGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVXHQXLXGGXGTY

SEQ ID NO: 337224 - protein, 20 aa, Artificial Sequence
  Description of Artificial Sequence: Synthetic peptide
  Seed: SPACQLVLHQILKGGSGTYC (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGSGTYC

SEQ ID NO: 337225 - protein, 20 aa, Artificial Sequence
  Description of Artificial Sequence: Synthetic peptide
  Seed: SPACQLVLHQILKGGSGTYC (PMEL_HUMAN)
  Core: LHQILKGGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVXHQXLXGGXGTYC

SEQ ID NO: 337226 - protein, 21 aa, Artificial Sequence
  Description of Artificial Sequence: Synthetic peptide
  Seed: SPACQLVLHQILKGGSGTYCL (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGSGTYCL

SEQ ID NO: 337227 - protein, 21 aa, Artificial Sequence
  Description of Artificial Sequence: Synthetic peptide
  Seed: SPACQLVLHQILKGGSGTYCL (PMEL_HUMAN)
  Core: LHQILKGGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVXHQXLXGGXGTYCL

SEQ ID NO: 337228 - protein, 22 aa, Artificial Sequence
  Description of Artificial Sequence: Synthetic peptide
  Seed: SPACQLVLHQILKGGSGTYCLN (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGSGTYCLN

SEQ ID NO: 337229 - protein, 22 aa, Artificial Sequence
  Description of Artificial Sequence: Synthetic peptide
  Seed: SPACQLVLHQILKGGSGTYCLN (PMEL_HUMAN)
  Core: LHQILKGGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVXHQXLXGGXGTYCLN

SEQ ID NO: 337230 - protein, 23 aa, Artificial Sequence
  Description of Artificial Sequence: Synthetic peptide
  Seed: SPACQLVLHQILKGGSGTYCLNV (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGSGTYCLNV

SEQ ID NO: 337231 - protein, 23 aa, Artificial Sequence
  Description of Artificial Sequence: Synthetic peptide
  Seed: SPACQLVLHQILKGGSGTYCLNV (PMEL_HUMAN)
  Core: LHQILKGGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVXHQXLXGGXGTYCLNV

SEQ ID NO: 337232 - protein, 24 aa, Artificial Sequence
  Description of Artificial Sequence: Synthetic peptide
  Seed: SPACQLVLHQILKGGSGTYCLNVS (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGSGTYCLNVS

SEQ ID NO: 337233 - protein, 24 aa, Artificial Sequence
  Description of Artificial Sequence: Synthetic peptide
  Seed: SPACQLVLHQILKGGSGTYCLNVS (PMEL_HUMAN)
  Core: LHQILKGGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVXHQXLXGGXGTYCLNVS

SEQ ID NO: 337234 - protein, 24 aa, Artificial Sequence
  Description of Artificial Sequence: Synthetic peptide
  Seed: SPACQLVLHQILKGGSGTYCLNVS (PMEL_HUMAN)
  Core: LKGGSGTYC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVLHQIXKGXSXTYXLNVS

SEQ ID NO: 337235 - protein, 25 aa, Artificial Sequence
  Description of Artificial Sequence: Synthetic peptide
  Seed: SPACQLVLHQILKGGSGTYCLNVSL (PMEL_HUMAN)
  Core: LVLHQILKG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SPACQXVLXQXLKXGSGTYCLNVSL

SEQ ID NO: 337236 - protein, 25 aa, Artificial Sequence
  Description of Artificial Sequence: Synthetic peptide
  Seed: SPACQLVLHQILKGGSGTYCLNVSL (PMEL_HUMAN)
  Core: LHQILKGGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVXHQXLXGGXGTYCLNVSL

SEQ ID NO: 337237 - protein, 25 aa, Artificial Sequence
  Description of Artificial Sequence: Synthetic peptide
  Seed: SPACQLVLHQILKGGSGTYCLNVSL (PMEL_HUMAN)
  Core: LKGGSGTYC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SPACQLVLHQIXKGXSXTYXLNVSL

SEQ ID NO: 337238 - protein, 24 aa, Artificial Sequence
  Description of Artificial Sequence: Synthetic peptide
  Seed: SPGCQPPAQRLCQPVLPSPACQLV (PMEL_HUMAN)
  Core: QRLCQPVLP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SPGCQPPAXRLXQXVLXSPACQLV

SEQ ID NO: 337239 - protein, 25 aa, Artificial Sequence
  Description of Artificial Sequence: Synthetic peptide
  Seed: SPGCQPPAQRLCQPVLPSPACQLVL (PMEL_HUMAN)
  Core: QRLCQPVLP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SPGCQPPAXRLXQXVLXSPACQLVL

SEQ ID NO: 337240 - protein, 25 aa, Artificial Sequence
  Description of Artificial Sequence: Synthetic peptide
  Seed: SPGCQPPAQRLCQPVLPSPACQLVL (PMEL_HUMAN)
  Core: VLPSPACQL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SPGCQPPAQRLCQPXLPXPXCQXVL

SEQ ID NO: 337241 - protein, 14 aa, Artificial Sequence
  Description of Artificial Sequence: Synthetic peptide
  Seed: SQKRSFVYVWKTWG (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWG

SEQ ID NO: 337242 - protein, 14 aa, Artificial Sequence
  Description of Artificial Sequence: Synthetic peptide
  Seed: SQKRSFVYVWKTWG (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWX

SEQ ID NO: 337243 - protein, 15 aa, Artificial Sequence
  Description of Artificial Sequence: Synthetic peptide
  Seed: SQKRSFVYVWKTWGQ (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQ

SEQ ID NO: 337244 - protein, 15 aa, Artificial Sequence
  Description of Artificial Sequence: Synthetic peptide
  Seed: SQKRSFVYVWKTWGQ (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQ

SEQ ID NO: 337245 - protein, 15 aa, Artificial Sequence
  Description of Artificial Sequence: Synthetic peptide
  Seed: SQKRSFVYVWKTWGQ (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGX

SEQ ID NO: 337246 - protein, 16 aa, Artificial Sequence
  Description of Artificial Sequence: Synthetic peptide
  Seed: SQKRSFVYVWKTWGQY (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQY

SEQ ID NO: 337247 - protein, 16 aa, Artificial Sequence
  Description of Artificial Sequence: Synthetic peptide
  Seed: SQKRSFVYVWKTWGQY (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQY

SEQ ID NO: 337248 - protein, 16 aa, Artificial Sequence
  Description of Artificial Sequence: Synthetic peptide
  Seed: SQKRSFVYVWKTWGQY (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXY

SEQ ID NO: 337249 - protein, 16 aa, Artificial Sequence
  Description of Artificial Sequence: Synthetic peptide
  Seed: SQKRSFVYVWKTWGQY (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQX

SEQ ID NO: 337250 - protein, 17 aa, Artificial Sequence
  Description of Artificial Sequence: Synthetic peptide
  Seed: SQKRSFVYVWKTWGQYW (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQYW

SEQ ID NO: 337251 - protein, 17 aa, Artificial Sequence
  Description of Artificial Sequence: Synthetic peptide
  Seed: SQKRSFVYVWKTWGQYW (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQYW

SEQ ID NO: 337252 - protein, 17 aa, Artificial Sequence
  Description of Artificial Sequence: Synthetic peptide
  Seed: SQKRSFVYVWKTWGQYW (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXYW

SEQ ID NO: 337253 - protein, 17 aa, Artificial Sequence
  Description of Artificial Sequence: Synthetic peptide
  Seed: SQKRSFVYVWKTWGQYW (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQXW

SEQ ID NO: 337254 - protein, 18 aa, Artificial Sequence
  Description of Artificial Sequence: Synthetic peptide
  Seed: SQKRSFVYVWKTWGQYWQ (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQYWQ

SEQ ID NO: 337255 - protein, 18 aa, Artificial Sequence
  Description of Artificial Sequence: Synthetic peptide
  Seed: SQKRSFVYVWKTWGQYWQ (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQYWQ

SEQ ID NO: 337256 - protein, 18 aa, Artificial Sequence
  Description of Artificial Sequence: Synthetic peptide
  Seed: SQKRSFVYVWKTWGQYWQ (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXYWQ

SEQ ID NO: 337257 - protein, 18 aa, Artificial Sequence
  Description of Artificial Sequence: Synthetic peptide
  Seed: SQKRSFVYVWKTWGQYWQ (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQXWQ

SEQ ID NO: 337258 - protein, 19 aa, Artificial Sequence
  Description of Artificial Sequence: Synthetic peptide
  Seed: SQKRSFVYVWKTWGQYWQV (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQYWQV

SEQ ID NO: 337259 - protein, 19 aa, Artificial Sequence
  Description of Artificial Sequence: Synthetic peptide
  Seed: SQKRSFVYVWKTWGQYWQV (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQYWQV

SEQ ID NO: 337260 - protein, 19 aa, Artificial Sequence
  Description of Artificial Sequence: Synthetic peptide
  Seed: SQKRSFVYVWKTWGQYWQV (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXYWQV

SEQ ID NO: 337261 - protein, 19 aa, Artificial Sequence
  Description of Artificial Sequence: Synthetic peptide
  Seed: SQKRSFVYVWKTWGQYWQV (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQXWQV

SEQ ID NO: 337262 - protein, 20 aa, Artificial Sequence
  Description of Artificial Sequence: Synthetic peptide
  Seed: SQKRSFVYVWKTWGQYWQVL (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQYWQVL

SEQ ID NO: 337263 - protein, 20 aa, Artificial Sequence
  Description of Artificial Sequence: Synthetic peptide
  Seed: SQKRSFVYVWKTWGQYWQVL (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQYWQVL

SEQ ID NO: 337264 - protein, 20 aa, Artificial Sequence
  Description of Artificial Sequence: Synthetic peptide
  Seed: SQKRSFVYVWKTWGQYWQVL (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXYWQVL

SEQ ID NO: 337265 - protein, 20 aa, Artificial Sequence
  Description of Artificial Sequence: Synthetic peptide
  Seed: SQKRSFVYVWKTWGQYWQVL (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQXWQVL

SEQ ID NO: 337266 - protein, 21 aa, Artificial Sequence
  Description of Artificial Sequence: Synthetic peptide
  Seed: SQKRSFVYVWKTWGQYWQVLG (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQYWQVLG

SEQ ID NO: 337267 - protein, 21 aa, Artificial Sequence
  Description of Artificial Sequence: Synthetic peptide
  Seed: SQKRSFVYVWKTWGQYWQVLG (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQYWQVLG

SEQ ID NO: 337268 - protein, 21 aa, Artificial Sequence
  Description of Artificial Sequence: Synthetic peptide
  Seed: SQKRSFVYVWKTWGQYWQVLG (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXYWQVLG

SEQ ID NO: 337269 - protein, 21 aa, Artificial Sequence
  Description of Artificial Sequence: Synthetic peptide
  Seed: SQKRSFVYVWKTWGQYWQVLG (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQXWQVLG

SEQ ID NO: 337270 - protein, 22 aa, Artificial Sequence
  Description of Artificial Sequence: Synthetic peptide
  Seed: SQKRSFVYVWKTWGQYWQVLGG (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQYWQVLGG

SEQ ID NO: 337271 - protein, 22 aa, Artificial Sequence
  Description of Artificial Sequence: Synthetic peptide
  Seed: SQKRSFVYVWKTWGQYWQVLGG (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQYWQVLGG

SEQ ID NO: 337272 - protein, 22 aa, Artificial Sequence
  Description of Artificial Sequence: Synthetic peptide
  Seed: SQKRSFVYVWKTWGQYWQVLGG (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXYWQVLGG

SEQ ID NO: 337273 - protein, 22 aa, Artificial Sequence
  Description of Artificial Sequence: Synthetic peptide
  Seed: SQKRSFVYVWKTWGQYWQVLGG (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQXWQVLGG

SEQ ID NO: 337274 - protein, 23 aa, Artificial Sequence
  Description of Artificial Sequence: Synthetic peptide
  Seed: SQKRSFVYVWKTWGQYWQVLGGP (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQYWQVLGGP

SEQ ID NO: 337275 - protein, 23 aa, Artificial Sequence
  Description of Artificial Sequence: Synthetic peptide
  Seed: SQKRSFVYVWKTWGQYWQVLGGP (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQYWQVLGGP

SEQ ID NO: 337276 - protein, 23 aa, Artificial Sequence
  Description of Artificial Sequence: Synthetic peptide
  Seed: SQKRSFVYVWKTWGQYWQVLGGP (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXYWQVLGGP

SEQ ID NO: 337277 - protein, 23 aa, Artificial Sequence
  Description of Artificial Sequence: Synthetic peptide
  Seed: SQKRSFVYVWKTWGQYWQVLGGP (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQXWQVLGGP

SEQ ID NO: 337278 - protein, 23 aa, Artificial Sequence
  Description of Artificial Sequence: Synthetic peptide
  Seed: SQKRSFVYVWKTWGQYWQVLGGP (PMEL_HUMAN)
  Core: TWGQYWQVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVYVWKXWGXYXQVXGGP

SEQ ID NO: 337279 - protein, 24 aa, Artificial Sequence
  Description of Artificial Sequence: Synthetic peptide
  Seed: SQKRSFVYVWKTWGQYWQVLGGPV (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQYWQVLGGPV

SEQ ID NO: 337280 - protein, 24 aa, Artificial Sequence
  Description of Artificial Sequence: Synthetic peptide
  Seed: SQKRSFVYVWKTWGQYWQVLGGPV (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQYWQVLGGPV

SEQ ID NO: 337281 - protein, 24 aa, Artificial Sequence
  Description of Artificial Sequence: Synthetic peptide
  Seed: SQKRSFVYVWKTWGQYWQVLGGPV (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXYWQVLGGPV

SEQ ID NO: 337282 - protein, 24 aa, Artificial Sequence
  Description of Artificial Sequence: Synthetic peptide
  Seed: SQKRSFVYVWKTWGQYWQVLGGPV (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQXWQVLGGPV

SEQ ID NO: 337283 - protein, 24 aa, Artificial Sequence
  Description of Artificial Sequence: Synthetic peptide
  Seed: SQKRSFVYVWKTWGQYWQVLGGPV (PMEL_HUMAN)
  Core: TWGQYWQVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVYVWKXWGXYXQVXGGPV

SEQ ID NO: 337284 - protein, 24 aa, Artificial Sequence
  Description of Artificial Sequence: Synthetic peptide
  Seed: SQKRSFVYVWKTWGQYWQVLGGPV (PMEL_HUMAN)
  Core: YWQVLGGPV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVYVWKTWGQXWQXLXGPX

SEQ ID NO: 337285 - protein, 25 aa, Artificial Sequence
  Description of Artificial Sequence: Synthetic peptide
  Seed: SQKRSFVYVWKTWGQYWQVLGGPVS (PMEL_HUMAN)
  Core: RSFVYVWKT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXSFXYXWKXWGQYWQVLGGPVS

SEQ ID NO: 337286 - protein, 25 aa, Artificial Sequence
  Description of Artificial Sequence: Synthetic peptide
  Seed: SQKRSFVYVWKTWGQYWQVLGGPVS (PMEL_HUMAN)
  Core: FVYVWKTWG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSXVYXWXTWXQYWQVLGGPVS

SEQ ID NO: 337287 - protein, 25 aa, Artificial Sequence
  Description of Artificial Sequence: Synthetic peptide
  Seed: SQKRSFVYVWKTWGQYWQVLGGPVS (PMEL_HUMAN)
  Core: VYVWKTWGQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFXYVXKXWGXYWQVLGGPVS

SEQ ID NO: 337288 - protein, 25 aa, Artificial Sequence
  Description of Artificial Sequence: Synthetic peptide
  Seed: SQKRSFVYVWKTWGQYWQVLGGPVS (PMEL_HUMAN)
  Core: YVWKTWGQY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVXVWXTXGQXWQVLGGPVS

SEQ ID NO: 337289 - protein, 25 aa, Artificial Sequence
  Description of Artificial Sequence: Synthetic peptide
  Seed: SQKRSFVYVWKTWGQYWQVLGGPVS (PMEL_HUMAN)
  Core: TWGQYWQVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVYVWKXWGXYXQVXGGPVS

SEQ ID NO: 337290 - protein, 25 aa, Artificial Sequence
  Description of Artificial Sequence: Synthetic peptide
  Seed: SQKRSFVYVWKTWGQYWQVLGGPVS (PMEL_HUMAN)
  Core: GQYWQVLGG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVYVWKTWXQYXQXLGXPVS

SEQ ID NO: 337291 - protein, 25 aa, Artificial Sequence
  Description of Artificial Sequence: Synthetic peptide
  Seed: SQKRSFVYVWKTWGQYWQVLGGPVS (PMEL_HUMAN)
  Core: YWQVLGGPV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SQKRSFVYVWKTWGQXWQXLXGPXS

SEQ ID NO: 337292 - protein, 15 aa, Artificial Sequence
  Description of Artificial Sequence: Synthetic peptide
  Seed: SQKVLPDGQVIWVNN (PMEL_HUMAN)
  Core: VLPDGQVIW
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQKXLPXGXVIXVNN

SEQ ID NO: 337293 - protein, 17 aa, Artificial Sequence
  Description of Artificial Sequence: Synthetic peptide
  Seed: SQKVLPDGQVIWVNNTI (PMEL_HUMAN)
  Core: QVIWVNNTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGXVIXVXNTX

SEQ ID NO: 337294 - protein, 18 aa, Artificial Sequence
  Description of Artificial Sequence: Synthetic peptide
  Seed: SQKVLPDGQVIWVNNTII (PMEL_HUMAN)
  Core: QVIWVNNTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGXVIXVXNTXI

SEQ ID NO: 337295 - protein, 19 aa, Artificial Sequence
  Description of Artificial Sequence: Synthetic peptide
  Seed: SQKVLPDGQVIWVNNTIIN (PMEL_HUMAN)
  Core: QVIWVNNTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGXVIXVXNTXIN

SEQ ID NO: 337296 - protein, 19 aa, Artificial Sequence
  Description of Artificial Sequence: Synthetic peptide
  Seed: SQKVLPDGQVIWVNNTIIN (PMEL_HUMAN)
  Core: VIWVNNTII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQXIWXNXTIXN

SEQ ID NO: 337297 - protein, 19 aa, Artificial Sequence
  Description of Artificial Sequence: Synthetic peptide
  Seed: SQKVLPDGQVIWVNNTIIN (PMEL_HUMAN)
  Core: IWVNNTIIN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQVXWVXNXIIX

SEQ ID NO: 337298 - protein, 20 aa, Artificial Sequence
  Description of Artificial Sequence: Synthetic peptide
  Seed: SQKVLPDGQVIWVNNTIING (PMEL_HUMAN)
  Core: QVIWVNNTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGXVIXVXNTXING

SEQ ID NO: 337299 - protein, 20 aa, Artificial Sequence
  Description of Artificial Sequence: Synthetic peptide
  Seed: SQKVLPDGQVIWVNNTIING (PMEL_HUMAN)
  Core: VIWVNNTII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQXIWXNXTIXNG

SEQ ID NO: 337300 - protein, 20 aa, Artificial Sequence
  Description of Artificial Sequence: Synthetic peptide
  Seed: SQKVLPDGQVIWVNNTIING (PMEL_HUMAN)
  Core: IWVNNTIIN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQVXWVXNXIIXG

SEQ ID NO: 337301 - protein, 21 aa, Artificial Sequence
  Description of Artificial Sequence: Synthetic peptide
  Seed: SQKVLPDGQVIWVNNTIINGS (PMEL_HUMAN)
  Core: QVIWVNNTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGXVIXVXNTXINGS

SEQ ID NO: 337302 - protein, 21 aa, Artificial Sequence
  Description of Artificial Sequence: Synthetic peptide
  Seed: SQKVLPDGQVIWVNNTIINGS (PMEL_HUMAN)
  Core: VIWVNNTII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQXIWXNXTIXNGS

SEQ ID NO: 337303 - protein, 21 aa, Artificial Sequence
  Description of Artificial Sequence: Synthetic peptide
  Seed: SQKVLPDGQVIWVNNTIINGS (PMEL_HUMAN)
  Core: IWVNNTIIN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQVXWVXNXIIXGS

SEQ ID NO: 337304 - protein, 22 aa, Artificial Sequence
  Description of Artificial Sequence: Synthetic peptide
  Seed: SQKVLPDGQVIWVNNTIINGSQ (PMEL_HUMAN)
  Core: QVIWVNNTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGXVIXVXNTXINGSQ

SEQ ID NO: 337305 - protein, 22 aa, Artificial Sequence
  Description of Artificial Sequence: Synthetic peptide
  Seed: SQKVLPDGQVIWVNNTIINGSQ (PMEL_HUMAN)
  Core: VIWVNNTII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQXIWXNXTIXNGSQ

SEQ ID NO: 337306 - protein, 22 aa, Artificial Sequence
  Description of Artificial Sequence: Synthetic peptide
  Seed: SQKVLPDGQVIWVNNTIINGSQ (PMEL_HUMAN)
  Core: IWVNNTIIN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQVXWVXNXIIXGSQ

SEQ ID NO: 337307 - protein, 23 aa, Artificial Sequence
  Description of Artificial Sequence: Synthetic peptide
  Seed: SQKVLPDGQVIWVNNTIINGSQV (PMEL_HUMAN)
  Core: QVIWVNNTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGXVIXVXNTXINGSQV

SEQ ID NO: 337308 - protein, 23 aa, Artificial Sequence
  Description of Artificial Sequence: Synthetic peptide
  Seed: SQKVLPDGQVIWVNNTIINGSQV (PMEL_HUMAN)
  Core: VIWVNNTII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQXIWXNXTIXNGSQV

SEQ ID NO: 337309 - protein, 23 aa, Artificial Sequence
  Description of Artificial Sequence: Synthetic peptide
  Seed: SQKVLPDGQVIWVNNTIINGSQV (PMEL_HUMAN)
  Core: IWVNNTIIN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQVXWVXNXIIXGSQV

SEQ ID NO: 337310 - protein, 24 aa, Artificial Sequence
  Description of Artificial Sequence: Synthetic peptide
  Seed: SQKVLPDGQVIWVNNTIINGSQVW (PMEL_HUMAN)
  Core: QVIWVNNTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGXVIXVXNTXINGSQVW

SEQ ID NO: 337311 - protein, 24 aa, Artificial Sequence
  Description of Artificial Sequence: Synthetic peptide
  Seed: SQKVLPDGQVIWVNNTIINGSQVW (PMEL_HUMAN)
  Core: VIWVNNTII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQXIWXNXTIXNGSQVW

SEQ ID NO: 337312 - protein, 24 aa, Artificial Sequence
  Description of Artificial Sequence: Synthetic peptide
  Seed: SQKVLPDGQVIWVNNTIINGSQVW (PMEL_HUMAN)
  Core: IWVNNTIIN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQVXWVXNXIIXGSQVW

SEQ ID NO: 337313 - protein, 24 aa, Artificial Sequence
  Description of Artificial Sequence: Synthetic peptide
  Seed: SQKVLPDGQVIWVNNTIINGSQVW (PMEL_HUMAN)
  Core: VNNTIINGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQVIWXNNXIXNGXQVW

SEQ ID NO: 337314 - protein, 25 aa, Artificial Sequence
  Description of Artificial Sequence: Synthetic peptide
  Seed: SQKVLPDGQVIWVNNTIINGSQVWG (PMEL_HUMAN)
  Core: QVIWVNNTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGXVIXVXNTXINGSQVWG

SEQ ID NO: 337315 - protein, 25 aa, Artificial Sequence
  Description of Artificial Sequence: Synthetic peptide
  Seed: SQKVLPDGQVIWVNNTIINGSQVWG (PMEL_HUMAN)
  Core: VIWVNNTII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQXIWXNXTIXNGSQVWG

SEQ ID NO: 337316 - protein, 25 aa, Artificial Sequence
  Description of Artificial Sequence: Synthetic peptide
  Seed: SQKVLPDGQVIWVNNTIINGSQVWG (PMEL_HUMAN)
  Core: IWVNNTIIN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQVXWVXNXIIXGSQVWG

SEQ ID NO: 337317 - protein, 25 aa, Artificial Sequence
  Description of Artificial Sequence: Synthetic peptide
  Seed: SQKVLPDGQVIWVNNTIINGSQVWG (PMEL_HUMAN)
  Core: VNNTIINGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SQKVLPDGQVIWXNNXIXNGXQVWG

SEQ ID NO: 337318 - protein, 15 aa, Artificial Sequence
  Description of Artificial Sequence: Synthetic peptide
  Seed: SQLRALDGGNKHFLR (PMEL_HUMAN)
  Core: LRALDGGNK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXRAXDXGNXHFLR

SEQ ID NO: 337319 - protein, 15 aa, Artificial Sequence
  Description of Artificial Sequence: Synthetic peptide
  Seed: SQLRALDGGNKHFLR (PMEL_HUMAN)
  Core: LDGGNKHFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQLRAXDGXNXHFXR

SEQ ID NO: 337320 - protein, 20 aa, Artificial Sequence
  Description of Artificial Sequence: Synthetic peptide
  Seed: SQLRALDGGNKHFLRNQPLT (PMEL_HUMAN)
  Core: KHFLRNQPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNXHFXRXQPXT

SEQ ID NO: 337321 - protein, 21 aa, Artificial Sequence
  Description of Artificial Sequence: Synthetic peptide
  Seed: SQLRALDGGNKHFLRNQPLTF (PMEL_HUMAN)
  Core: LDGGNKHFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQLRAXDGXNXHFXRNQPLTF

SEQ ID NO: 337322 - protein, 21 aa, Artificial Sequence
  Description of Artificial Sequence: Synthetic peptide
  Seed: SQLRALDGGNKHFLRNQPLTF (PMEL_HUMAN)
  Core: KHFLRNQPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNXHFXRXQPXTF

SEQ ID NO: 337323 - protein, 21 aa, Artificial Sequence
  Description of Artificial Sequence: Synthetic peptide
  Seed: SQLRALDGGNKHFLRNQPLTF (PMEL_HUMAN)
  Core: FLRNQPLTF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNKHXLRXQXLTX

SEQ ID NO: 337324 - protein, 22 aa, Artificial Sequence
  Description of Artificial Sequence: Synthetic peptide
  Seed: SQLRALDGGNKHFLRNQPLTFA (PMEL_HUMAN)
  Core: LDGGNKHFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQLRAXDGXNXHFXRNQPLTFA

SEQ ID NO: 337325 - protein, 22 aa, Artificial Sequence
  Description of Artificial Sequence: Synthetic peptide
  Seed: SQLRALDGGNKHFLRNQPLTFA (PMEL_HUMAN)
  Core: GGNKHFLRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDXGNXHXLRXQPLTFA

SEQ ID NO: 337326 - protein, 22 aa, Artificial Sequence
  Description of Artificial Sequence: Synthetic peptide
  Seed: SQLRALDGGNKHFLRNQPLTFA (PMEL_HUMAN)
  Core: KHFLRNQPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNXHFXRXQPXTFA

SEQ ID NO: 337327 - protein, 22 aa, Artificial Sequence
  Description of Artificial Sequence: Synthetic peptide
  Seed: SQLRALDGGNKHFLRNQPLTFA (PMEL_HUMAN)
  Core: FLRNQPLTF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNKHXLRXQXLTXA

SEQ ID NO: 337328 - protein, 23 aa, Artificial Sequence
  Description of Artificial Sequence: Synthetic peptide
  Seed: SQLRALDGGNKHFLRNQPLTFAL (PMEL_HUMAN)
  Core: LDGGNKHFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQLRAXDGXNXHFXRNQPLTFAL

SEQ ID NO: 337329 - protein, 23 aa, Artificial Sequence
  Description of Artificial Sequence: Synthetic peptide
  Seed: SQLRALDGGNKHFLRNQPLTFAL (PMEL_HUMAN)
  Core: GGNKHFLRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDXGNXHXLRXQPLTFAL

SEQ ID NO: 337330 - protein, 23 aa, Artificial Sequence
  Description of Artificial Sequence: Synthetic peptide
  Seed: SQLRALDGGNKHFLRNQPLTFAL (PMEL_HUMAN)
  Core: KHFLRNQPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNXHFXRXQPXTFAL

SEQ ID NO: 337331 - protein, 23 aa, Artificial Sequence
  Description of Artificial Sequence: Synthetic peptide
  Seed: SQLRALDGGNKHFLRNQPLTFAL (PMEL_HUMAN)
  Core: FLRNQPLTF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNKHXLRXQXLTXAL

SEQ ID NO: 337332 - protein, 23 aa, Artificial Sequence
  Description of Artificial Sequence: Synthetic peptide
  Seed: SQLRALDGGNKHFLRNQPLTFAL (PMEL_HUMAN)
  Core: LRNQPLTFA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNKHFXRNXPXTFXL

SEQ ID NO: 337333 - protein, 24 aa, Artificial Sequence
  Description of Artificial Sequence: Synthetic peptide
  Seed: SQLRALDGGNKHFLRNQPLTFALQ (PMEL_HUMAN)
  Core: RALDGGNKH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQLXALXGXNKXFLRNQPLTFALQ

SEQ ID NO: 337334 - protein, 24 aa, Artificial Sequence
  Description of Artificial Sequence: Synthetic peptide
  Seed: SQLRALDGGNKHFLRNQPLTFALQ (PMEL_HUMAN)
  Core: LDGGNKHFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SQLRAXDGXNXHFXRNQPLTFALQ

SEQ ID NO: 337335 - protein, 24 aa, Artificial Sequence
  Description of Artificial Sequence: Synthetic peptide
  Seed: SQLRALDGGNKHFLRNQPLTFALQ (PMEL_HUMAN)
  Core: GGNKHFLRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDXGNXHXLRXQPLTFALQ

SEQ ID NO: 337336 - protein, 24 aa, Artificial Sequence
  Description of Artificial Sequence: Synthetic peptide
  Seed: SQLRALDGGNKHFLRNQPLTFALQ (PMEL_HUMAN)
  Core: KHFLRNQPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNXHFXRXQPXTFALQ

SEQ ID NO: 337337 - protein, 24 aa, Artificial Sequence
  Description of Artificial Sequence: Synthetic peptide
  Seed: SQLRALDGGNKHFLRNQPLTFALQ (PMEL_HUMAN)
  Core: FLRNQPLTF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNKHXLRXQXLTXALQ

SEQ ID NO: 337338 - protein, 24 aa, Artificial Sequence
  Description of Artificial Sequence: Synthetic peptide
  Seed: SQLRALDGGNKHFLRNQPLTFALQ (PMEL_HUMAN)
  Core: LRNQPLTFA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNKHFXRNXPXTFXLQ

SEQ ID NO: 337339 - protein, 25 aa, Artificial Sequence
  Description of Artificial Sequence: Synthetic peptide
  Seed: SQLRALDGGNKHFLRNQPLTFALQL (PMEL_HUMAN)
  Core: RALDGGNKH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SQLXALXGXNKXFLRNQPLTFALQL

SEQ ID NO: 337340 - protein, 25 aa, Artificial Sequence
  Description of Artificial Sequence: Synthetic peptide
  Seed: SQLRALDGGNKHFLRNQPLTFALQL (PMEL_HUMAN)
  Core: GGNKHFLRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDXGNXHXLRXQPLTFALQL

SEQ ID NO: 337341 - protein, 25 aa, Artificial Sequence
  Description of Artificial Sequence: Synthetic peptide
  Seed: SQLRALDGGNKHFLRNQPLTFALQL (PMEL_HUMAN)
  Core: KHFLRNQPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNXHFXRXQPXTFALQL

SEQ ID NO: 337342 - protein, 25 aa, Artificial Sequence
  Description of Artificial Sequence: Synthetic peptide
  Seed: SQLRALDGGNKHFLRNQPLTFALQL (PMEL_HUMAN)
  Core: FLRNQPLTF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNKHXLRXQXLTXALQL

SEQ ID NO: 337343 - protein, 25 aa, Artificial Sequence
  Description of Artificial Sequence: Synthetic peptide
  Seed: SQLRALDGGNKHFLRNQPLTFALQL (PMEL_HUMAN)
  Core: LRNQPLTFA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SQLRALDGGNKHFXRNXPXTFXLQL

SEQ ID NO: 337344 - protein, 13 aa, Artificial Sequence
  Description of Artificial Sequence: Synthetic peptide
  Seed: SQVWGGQPVYPQE (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQE

SEQ ID NO: 337345 - protein, 14 aa, Artificial Sequence
  Description of Artificial Sequence: Synthetic peptide
  Seed: SQVWGGQPVYPQET (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQET

SEQ ID NO: 337346 - protein, 15 aa, Artificial Sequence
  Description of Artificial Sequence: Synthetic peptide
  Seed: SQVWGGQPVYPQETD (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETD

SEQ ID NO: 337347 - protein, 16 aa, Artificial Sequence
  Description of Artificial Sequence: Synthetic peptide
  Seed: SQVWGGQPVYPQETDD (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDD

SEQ ID NO: 337348 - protein, 17 aa, Artificial Sequence
  Description of Artificial Sequence: Synthetic peptide
  Seed: SQVWGGQPVYPQETDDA (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDDA

SEQ ID NO: 337349 - protein, 18 aa, Artificial Sequence
  Description of Artificial Sequence: Synthetic peptide
  Seed: SQVWGGQPVYPQETDDAC (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDDAC

SEQ ID NO: 337350 - protein, 19 aa, Artificial Sequence
  Description of Artificial Sequence: Synthetic peptide
  Seed: SQVWGGQPVYPQETDDACI (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDDACI

SEQ ID NO: 337351 - protein, 20 aa, Artificial Sequence
  Description of Artificial Sequence: Synthetic peptide
  Seed: SQVWGGQPVYPQETDDACIF (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDDACIF

SEQ ID NO: 337352 - protein, 21 aa, Artificial Sequence
  Description of Artificial Sequence: Synthetic peptide
  Seed: SQVWGGQPVYPQETDDACIFP (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDDACIFP

SEQ ID NO: 337353 - protein, 22 aa, Artificial Sequence
  Description of Artificial Sequence: Synthetic peptide
  Seed: SQVWGGQPVYPQETDDACIFPD (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDDACIFPD

SEQ ID NO: 337354 - protein, 23 aa, Artificial Sequence
  Description of Artificial Sequence: Synthetic peptide
  Seed: SQVWGGQPVYPQETDDACIFPDG (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDDACIFPDG

SEQ ID NO: 337355 - protein, 24 aa, Artificial Sequence
  Description of Artificial Sequence: Synthetic peptide
  Seed: SQVWGGQPVYPQETDDACIFPDGG (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDDACIFPDGG

SEQ ID NO: 337356 - protein, 25 aa, Artificial Sequence
  Description of Artificial Sequence: Synthetic peptide
  Seed: SQVWGGQPVYPQETDDACIFPDGGP (PMEL_HUMAN)
  Core: VWGGQPVYP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SQXWGXQXVYXQETDDACIFPDGGP

SEQ ID NO: 337357 - protein, 13 aa, Artificial Sequence
  Description of Artificial Sequence: Synthetic peptide
  Seed: SRALVVTHTYLEP (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXP

SEQ ID NO: 337358 - protein, 13 aa, Artificial Sequence
  Description of Artificial Sequence: Synthetic peptide
  Seed: SRALVVTHTYLEP (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEX

SEQ ID NO: 337359 - protein, 14 aa, Artificial Sequence
  Description of Artificial Sequence: Synthetic peptide
  Seed: SRALVVTHTYLEPG (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPG

SEQ ID NO: 337360 - protein, 14 aa, Artificial Sequence
  Description of Artificial Sequence: Synthetic peptide
  Seed: SRALVVTHTYLEPG (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXG

SEQ ID NO: 337361 - protein, 15 aa, Artificial Sequence
  Description of Artificial Sequence: Synthetic peptide
  Seed: SRALVVTHTYLEPGP (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGP

SEQ ID NO: 337362 - protein, 15 aa, Artificial Sequence
  Description of Artificial Sequence: Synthetic peptide
  Seed: SRALVVTHTYLEPGP (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGP

SEQ ID NO: 337363 - protein, 16 aa, Artificial Sequence
  Description of Artificial Sequence: Synthetic peptide
  Seed: SRALVVTHTYLEPGPV (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPV

SEQ ID NO: 337364 - protein, 16 aa, Artificial Sequence
  Description of Artificial Sequence: Synthetic peptide
  Seed: SRALVVTHTYLEPGPV (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPV

SEQ ID NO: 337365 - protein, 16 aa, Artificial Sequence
  Description of Artificial Sequence: Synthetic peptide
  Seed: SRALVVTHTYLEPGPV (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPV

SEQ ID NO: 337366 - protein, 17 aa, Artificial Sequence
  Description of Artificial Sequence: Synthetic peptide
  Seed: SRALVVTHTYLEPGPVT (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPVT

SEQ ID NO: 337367 - protein, 17 aa, Artificial Sequence
  Description of Artificial Sequence: Synthetic peptide
  Seed: SRALVVTHTYLEPGPVT (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPVT

SEQ ID NO: 337368 - protein, 17 aa, Artificial Sequence
  Description of Artificial Sequence: Synthetic peptide
  Seed: SRALVVTHTYLEPGPVT (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPVT

SEQ ID NO: 337369 - protein, 18 aa, Artificial Sequence
  Description of Artificial Sequence: Synthetic peptide
  Seed: SRALVVTHTYLEPGPVTA (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPVTA

SEQ ID NO: 337370 - protein, 18 aa, Artificial Sequence
  Description of Artificial Sequence: Synthetic peptide
  Seed: SRALVVTHTYLEPGPVTA (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPVTA

SEQ ID NO: 337371 - protein, 18 aa, Artificial Sequence
  Description of Artificial Sequence: Synthetic peptide
  Seed: SRALVVTHTYLEPGPVTA (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPVTA

SEQ ID NO: 337372 - protein, 19 aa, Artificial Sequence
  Description of Artificial Sequence: Synthetic peptide
  Seed: SRALVVTHTYLEPGPVTAQ (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPVTAQ

SEQ ID NO: 337373 - protein, 19 aa, Artificial Sequence
  Description of Artificial Sequence: Synthetic peptide
  Seed: SRALVVTHTYLEPGPVTAQ (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPVTAQ

SEQ ID NO: 337374 - protein, 19 aa, Artificial Sequence
  Description of Artificial Sequence: Synthetic peptide
  Seed: SRALVVTHTYLEPGPVTAQ (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPVTAQ

SEQ ID NO: 337375 - protein, 20 aa, Artificial Sequence
  Description of Artificial Sequence: Synthetic peptide
  Seed: SRALVVTHTYLEPGPVTAQV (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPVTAQV

SEQ ID NO: 337376 - protein, 20 aa, Artificial Sequence
  Description of Artificial Sequence: Synthetic peptide
  Seed: SRALVVTHTYLEPGPVTAQV (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPVTAQV

SEQ ID NO: 337377 - protein, 20 aa, Artificial Sequence
  Description of Artificial Sequence: Synthetic peptide
  Seed: SRALVVTHTYLEPGPVTAQV (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPVTAQV

SEQ ID NO: 337378 - protein, 20 aa, Artificial Sequence
  Description of Artificial Sequence: Synthetic peptide
  Seed: SRALVVTHTYLEPGPVTAQV (PMEL_HUMAN)
  Core: HTYLEPGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTXTYXEXGPXTAQV

SEQ ID NO: 337379 - protein, 21 aa, Artificial Sequence
  Description of Artificial Sequence: Synthetic peptide
  Seed: SRALVVTHTYLEPGPVTAQVV (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPVTAQVV

SEQ ID NO: 337380 - protein, 21 aa, Artificial Sequence
  Description of Artificial Sequence: Synthetic peptide
  Seed: SRALVVTHTYLEPGPVTAQVV (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPVTAQVV

SEQ ID NO: 337381 - protein, 21 aa, Artificial Sequence
  Description of Artificial Sequence: Synthetic peptide
  Seed: SRALVVTHTYLEPGPVTAQVV (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPVTAQVV

SEQ ID NO: 337382 - protein, 21 aa, Artificial Sequence
  Description of Artificial Sequence: Synthetic peptide
  Seed: SRALVVTHTYLEPGPVTAQVV (PMEL_HUMAN)
  Core: HTYLEPGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTXTYXEXGPXTAQVV

SEQ ID NO: 337383 - protein, 22 aa, Artificial Sequence
  Description of Artificial Sequence: Synthetic peptide
  Seed: SRALVVTHTYLEPGPVTAQVVL (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPVTAQVVL

SEQ ID NO: 337384 - protein, 22 aa, Artificial Sequence
  Description of Artificial Sequence: Synthetic peptide
  Seed: SRALVVTHTYLEPGPVTAQVVL (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPVTAQVVL

SEQ ID NO: 337385 - protein, 22 aa, Artificial Sequence
  Description of Artificial Sequence: Synthetic peptide
  Seed: SRALVVTHTYLEPGPVTAQVVL (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPVTAQVVL

SEQ ID NO: 337386 - protein, 22 aa, Artificial Sequence
  Description of Artificial Sequence: Synthetic peptide
  Seed: SRALVVTHTYLEPGPVTAQVVL (PMEL_HUMAN)
  Core: HTYLEPGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTXTYXEXGPXTAQVVL

SEQ ID NO: 337387 - protein, 23 aa, Artificial Sequence
  Description of Artificial Sequence: Synthetic peptide
  Seed: SRALVVTHTYLEPGPVTAQVVLQ (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPVTAQVVLQ

SEQ ID NO: 337388 - protein, 23 aa, Artificial Sequence
  Description of Artificial Sequence: Synthetic peptide
  Seed: SRALVVTHTYLEPGPVTAQVVLQ (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPVTAQVVLQ

SEQ ID NO: 337389 - protein, 23 aa, Artificial Sequence
  Description of Artificial Sequence: Synthetic peptide
  Seed: SRALVVTHTYLEPGPVTAQVVLQ (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPVTAQVVLQ

SEQ ID NO: 337390 - protein, 23 aa, Artificial Sequence
  Description of Artificial Sequence: Synthetic peptide
  Seed: SRALVVTHTYLEPGPVTAQVVLQ (PMEL_HUMAN)
  Core: HTYLEPGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTXTYXEXGPXTAQVVLQ

SEQ ID NO: 337391 - protein, 23 aa, Artificial Sequence
  Description of Artificial Sequence: Synthetic peptide
  Seed: SRALVVTHTYLEPGPVTAQVVLQ (PMEL_HUMAN)
  Core: PGPVTAQVV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTHTYLEXGPXTXQVXLQ

SEQ ID NO: 337392 - protein, 23 aa, Artificial Sequence
  Description of Artificial Sequence: Synthetic peptide
  Seed: SRALVVTHTYLEPGPVTAQVVLQ (PMEL_HUMAN)
  Core: PVTAQVVLQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTHTYLEPGXVTXQXVLX

SEQ ID NO: 337393 - protein, 24 aa, Artificial Sequence
  Description of Artificial Sequence: Synthetic peptide
  Seed: SRALVVTHTYLEPGPVTAQVVLQA (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPVTAQVVLQA

SEQ ID NO: 337394 - protein, 24 aa, Artificial Sequence
  Description of Artificial Sequence: Synthetic peptide
  Seed: SRALVVTHTYLEPGPVTAQVVLQA (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPVTAQVVLQA

SEQ ID NO: 337395 - protein, 24 aa, Artificial Sequence
  Description of Artificial Sequence: Synthetic peptide
  Seed: SRALVVTHTYLEPGPVTAQVVLQA (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPVTAQVVLQA

SEQ ID NO: 337396 - protein, 24 aa, Artificial Sequence
  Description of Artificial Sequence: Synthetic peptide
  Seed: SRALVVTHTYLEPGPVTAQVVLQA (PMEL_HUMAN)
  Core: HTYLEPGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTXTYXEXGPXTAQVVLQA

SEQ ID NO: 337397 - protein, 24 aa, Artificial Sequence
  Description of Artificial Sequence: Synthetic peptide
  Seed: SRALVVTHTYLEPGPVTAQVVLQA (PMEL_HUMAN)
  Core: PGPVTAQVV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTHTYLEXGPXTXQVXLQA

SEQ ID NO: 337398 - protein, 24 aa, Artificial Sequence
  Description of Artificial Sequence: Synthetic peptide
  Seed: SRALVVTHTYLEPGPVTAQVVLQA (PMEL_HUMAN)
  Core: PVTAQVVLQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTHTYLEPGXVTXQXVLXA

SEQ ID NO: 337399 - protein, 25 aa, Artificial Sequence
  Description of Artificial Sequence: Synthetic peptide
  Seed: SRALVVTHTYLEPGPVTAQVVLQAA (PMEL_HUMAN)
  Core: LVVTHTYLE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRAXVVXHXYLXPGPVTAQVVLQAA

SEQ ID NO: 337400 - protein, 25 aa, Artificial Sequence
  Description of Artificial Sequence: Synthetic peptide
  Seed: SRALVVTHTYLEPGPVTAQVVLQAA (PMEL_HUMAN)
  Core: VVTHTYLEP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRALXVTXTXLEXGPVTAQVVLQAA

SEQ ID NO: 337401 - protein, 25 aa, Artificial Sequence
  Description of Artificial Sequence: Synthetic peptide
  Seed: SRALVVTHTYLEPGPVTAQVVLQAA (PMEL_HUMAN)
  Core: VTHTYLEPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRALVXTHXYXEPXPVTAQVVLQAA

SEQ ID NO: 337402 - protein, 25 aa, Artificial Sequence
  Description of Artificial Sequence: Synthetic peptide
  Seed: SRALVVTHTYLEPGPVTAQVVLQAA (PMEL_HUMAN)
  Core: HTYLEPGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTXTYXEXGPXTAQVVLQAA

SEQ ID NO: 337403 - protein, 25 aa, Artificial Sequence
  Description of Artificial Sequence: Synthetic peptide
  Seed: SRALVVTHTYLEPGPVTAQVVLQAA (PMEL_HUMAN)
  Core: PVTAQVVLQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTHTYLEPGXVTXQXVLXAA

SEQ ID NO: 337404 - protein, 25 aa, Artificial Sequence
  Description of Artificial Sequence: Synthetic peptide
  Seed: SRALVVTHTYLEPGPVTAQVVLQAA (PMEL_HUMAN)
  Core: VTAQVVLQA
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SRALVVTHTYLEPGPXTAXVXLQXA

SEQ ID NO: 337405 - protein, 14 aa, Artificial Sequence
  Description of Artificial Sequence: Synthetic peptide
  Seed: SRQLRTKAWNRQLY (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLY

SEQ ID NO: 337406 - protein, 14 aa, Artificial Sequence
  Description of Artificial Sequence: Synthetic peptide
  Seed: SRQLRTKAWNRQLY (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLX

SEQ ID NO: 337407 - protein, 15 aa, Artificial Sequence
  Description of Artificial Sequence: Synthetic peptide
  Seed: SRQLRTKAWNRQLYP (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYP

SEQ ID NO: 337408 - protein, 15 aa, Artificial Sequence
  Description of Artificial Sequence: Synthetic peptide
  Seed: SRQLRTKAWNRQLYP (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXP

SEQ ID NO: 337409 - protein, 16 aa, Artificial Sequence
  Description of Artificial Sequence: Synthetic peptide
  Seed: SRQLRTKAWNRQLYPE (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYPE

SEQ ID NO: 337410 - protein, 16 aa, Artificial Sequence
  Description of Artificial Sequence: Synthetic peptide
  Seed: SRQLRTKAWNRQLYPE (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPE

SEQ ID NO: 337411 - protein, 17 aa, Artificial Sequence
  Description of Artificial Sequence: Synthetic peptide
  Seed: SRQLRTKAWNRQLYPEW (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYPEW

SEQ ID NO: 337412 - protein, 17 aa, Artificial Sequence
  Description of Artificial Sequence: Synthetic peptide
  Seed: SRQLRTKAWNRQLYPEW (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPEW

SEQ ID NO: 337413 - protein, 18 aa, Artificial Sequence
  Description of Artificial Sequence: Synthetic peptide
  Seed: SRQLRTKAWNRQLYPEWT (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPEWT

SEQ ID NO: 337414 - protein, 19 aa, Artificial Sequence
  Description of Artificial Sequence: Synthetic peptide
  Seed: SRQLRTKAWNRQLYPEWTE (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYPEWTE

SEQ ID NO: 337415 - protein, 19 aa, Artificial Sequence
  Description of Artificial Sequence: Synthetic peptide
  Seed: SRQLRTKAWNRQLYPEWTE (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPEWTE

SEQ ID NO: 337416 - protein, 20 aa, Artificial Sequence
  Description of Artificial Sequence: Synthetic peptide
  Seed: SRQLRTKAWNRQLYPEWTEA (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYPEWTEA

SEQ ID NO: 337417 - protein, 20 aa, Artificial Sequence
  Description of Artificial Sequence: Synthetic peptide
  Seed: SRQLRTKAWNRQLYPEWTEA (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPEWTEA

SEQ ID NO: 337418 - protein, 20 aa, Artificial Sequence
  Description of Artificial Sequence: Synthetic peptide
  Seed: SRQLRTKAWNRQLYPEWTEA (PMEL_HUMAN)
  Core: NRQLYPEWT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRTKAWXRQXYXEWXEA

SEQ ID NO: 337419 - protein, 21 aa, Artificial Sequence
  Description of Artificial Sequence: Synthetic peptide
  Seed: SRQLRTKAWNRQLYPEWTEAQ (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYPEWTEAQ

SEQ ID NO: 337420 - protein, 21 aa, Artificial Sequence
  Description of Artificial Sequence: Synthetic peptide
  Seed: SRQLRTKAWNRQLYPEWTEAQ (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPEWTEAQ

SEQ ID NO: 337421 - protein, 21 aa, Artificial Sequence
  Description of Artificial Sequence: Synthetic peptide
  Seed: SRQLRTKAWNRQLYPEWTEAQ (PMEL_HUMAN)
  Core: NRQLYPEWT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRTKAWXRQXYXEWXEAQ

SEQ ID NO: 337422 - protein, 22 aa, Artificial Sequence
  Description of Artificial Sequence: Synthetic peptide
  Seed: SRQLRTKAWNRQLYPEWTEAQR (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYPEWTEAQR

SEQ ID NO: 337423 - protein, 22 aa, Artificial Sequence
  Description of Artificial Sequence: Synthetic peptide
  Seed: SRQLRTKAWNRQLYPEWTEAQR (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPEWTEAQR

SEQ ID NO: 337424 - protein, 22 aa, Artificial Sequence
  Description of Artificial Sequence: Synthetic peptide
  Seed: SRQLRTKAWNRQLYPEWTEAQR (PMEL_HUMAN)
  Core: NRQLYPEWT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRTKAWXRQXYXEWXEAQR

SEQ ID NO: 337425 - protein, 22 aa, Artificial Sequence
  Description of Artificial Sequence: Synthetic peptide
  Seed: SRQLRTKAWNRQLYPEWTEAQR (PMEL_HUMAN)
  Core: LYPEWTEAQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRTKAWNRQXYPXWXEAXR

SEQ ID NO: 337426 - protein, 23 aa, Artificial Sequence
  Description of Artificial Sequence: Synthetic peptide
  Seed: SRQLRTKAWNRQLYPEWTEAQRL (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYPEWTEAQRL

SEQ ID NO: 337427 - protein, 23 aa, Artificial Sequence
  Description of Artificial Sequence: Synthetic peptide
  Seed: SRQLRTKAWNRQLYPEWTEAQRL (PMEL_HUMAN)
  Core: RTKAWNRQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRQLXTKXWXRQXYPEWTEAQRL

SEQ ID NO: 337428 - protein, 23 aa, Artificial Sequence
  Description of Artificial Sequence: Synthetic peptide
  Seed: SRQLRTKAWNRQLYPEWTEAQRL (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPEWTEAQRL

SEQ ID NO: 337429 - protein, 23 aa, Artificial Sequence
  Description of Artificial Sequence: Synthetic peptide
  Seed: SRQLRTKAWNRQLYPEWTEAQRL (PMEL_HUMAN)
  Core: NRQLYPEWT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRTKAWXRQXYXEWXEAQRL

SEQ ID NO: 337430 - protein, 23 aa, Artificial Sequence
  Description of Artificial Sequence: Synthetic peptide
  Seed: SRQLRTKAWNRQLYPEWTEAQRL (PMEL_HUMAN)
  Core: LYPEWTEAQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRTKAWNRQXYPXWXEAXRL

SEQ ID NO: 337431 - protein, 24 aa, Artificial Sequence
  Description of Artificial Sequence: Synthetic peptide
  Seed: SRQLRTKAWNRQLYPEWTEAQRLD (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYPEWTEAQRLD

SEQ ID NO: 337432 - protein, 24 aa, Artificial Sequence
  Description of Artificial Sequence: Synthetic peptide
  Seed: SRQLRTKAWNRQLYPEWTEAQRLD (PMEL_HUMAN)
  Core: RTKAWNRQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRQLXTKXWXRQXYPEWTEAQRLD

SEQ ID NO: 337433 - protein, 24 aa, Artificial Sequence
  Description of Artificial Sequence: Synthetic peptide
  Seed: SRQLRTKAWNRQLYPEWTEAQRLD (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPEWTEAQRLD

SEQ ID NO: 337434 - protein, 24 aa, Artificial Sequence
  Description of Artificial Sequence: Synthetic peptide
  Seed: SRQLRTKAWNRQLYPEWTEAQRLD (PMEL_HUMAN)
  Core: LYPEWTEAQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRTKAWNRQXYPXWXEAXRLD

SEQ ID NO: 337435 - protein, 25 aa, Artificial Sequence
  Description of Artificial Sequence: Synthetic peptide
  Seed: SRQLRTKAWNRQLYPEWTEAQRLDC (PMEL_HUMAN)
  Core: LRTKAWNRQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRQXRTXAXNRXLYPEWTEAQRLDC

SEQ ID NO: 337436 - protein, 25 aa, Artificial Sequence
  Description of Artificial Sequence: Synthetic peptide
  Seed: SRQLRTKAWNRQLYPEWTEAQRLDC (PMEL_HUMAN)
  Core: RTKAWNRQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRQLXTKXWXRQXYPEWTEAQRLDC

SEQ ID NO: 337437 - protein, 25 aa, Artificial Sequence
  Description of Artificial Sequence: Synthetic peptide
  Seed: SRQLRTKAWNRQLYPEWTEAQRLDC (PMEL_HUMAN)
  Core: TKAWNRQLY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRXKAXNXQLXPEWTEAQRLDC

SEQ ID NO: 337438 - protein, 25 aa, Artificial Sequence
  Description of Artificial Sequence: Synthetic peptide
  Seed: SRQLRTKAWNRQLYPEWTEAQRLDC (PMEL_HUMAN)
  Core: LYPEWTEAQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SRQLRTKAWNRQXYPXWXEAXRLDC

SEQ ID NO: 337439 - protein, 13 aa, Artificial Sequence
  Description of Artificial Sequence: Synthetic peptide
  Seed: SRSYVPLAHSSSA (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSA

SEQ ID NO: 337440 - protein, 13 aa, Artificial Sequence
  Description of Artificial Sequence: Synthetic peptide
  Seed: SRSYVPLAHSSSA (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXA

SEQ ID NO: 337441 - protein, 14 aa, Artificial Sequence
  Description of Artificial Sequence: Synthetic peptide
  Seed: SRSYVPLAHSSSAF (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAF

SEQ ID NO: 337442 - protein, 14 aa, Artificial Sequence
  Description of Artificial Sequence: Synthetic peptide
  Seed: SRSYVPLAHSSSAF (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAF

SEQ ID NO: 337443 - protein, 14 aa, Artificial Sequence
  Description of Artificial Sequence: Synthetic peptide
  Seed: SRSYVPLAHSSSAF (PMEL_HUMAN)
  Core: VPLAHSSSA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SRSYXPLXHXSSXF

SEQ ID NO: 337444 - protein, 15 aa, Artificial Sequence
  Description of Artificial Sequence: Synthetic peptide
  Seed: SRSYVPLAHSSSAFT (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFT

SEQ ID NO: 337445 - protein, 15 aa, Artificial Sequence
  Description of Artificial Sequence: Synthetic peptide
  Seed: SRSYVPLAHSSSAFT (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFT

SEQ ID NO: 337446 - protein, 15 aa, Artificial Sequence
  Description of Artificial Sequence: Synthetic peptide
  Seed: SRSYVPLAHSSSAFT (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFX

SEQ ID NO: 337447 - protein, 16 aa, Artificial Sequence
  Description of Artificial Sequence: Synthetic peptide
  Seed: SRSYVPLAHSSSAFTI (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFTI

SEQ ID NO: 337448 - protein, 16 aa, Artificial Sequence
  Description of Artificial Sequence: Synthetic peptide
  Seed: SRSYVPLAHSSSAFTI (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTI

SEQ ID NO: 337449 - protein, 16 aa, Artificial Sequence
  Description of Artificial Sequence: Synthetic peptide
  Seed: SRSYVPLAHSSSAFTI (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXI

SEQ ID NO: 337450 - protein, 16 aa, Artificial Sequence
  Description of Artificial Sequence: Synthetic peptide
  Seed: SRSYVPLAHSSSAFTI (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTX

SEQ ID NO: 337451 - protein, 17 aa, Artificial Sequence
  Description of Artificial Sequence: Synthetic peptide
  Seed: SRSYVPLAHSSSAFTIT (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFTIT

SEQ ID NO: 337452 - protein, 17 aa, Artificial Sequence
  Description of Artificial Sequence: Synthetic peptide
  Seed: SRSYVPLAHSSSAFTIT (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTIT

SEQ ID NO: 337453 - protein, 17 aa, Artificial Sequence
  Description of Artificial Sequence: Synthetic peptide
  Seed: SRSYVPLAHSSSAFTIT (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXIT

SEQ ID NO: 337454 - protein, 17 aa, Artificial Sequence
  Description of Artificial Sequence: Synthetic peptide
  Seed: SRSYVPLAHSSSAFTIT (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTXT

SEQ ID NO: 337455 - protein, 18 aa, Artificial Sequence
  Description of Artificial Sequence: Synthetic peptide
  Seed: SRSYVPLAHSSSAFTITD (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTITD

SEQ ID NO: 337456 - protein, 18 aa, Artificial Sequence
  Description of Artificial Sequence: Synthetic peptide
  Seed: SRSYVPLAHSSSAFTITD (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXITD

SEQ ID NO: 337457 - protein, 18 aa, Artificial Sequence
  Description of Artificial Sequence: Synthetic peptide
  Seed: SRSYVPLAHSSSAFTITD (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTXTD

SEQ ID NO: 337458 - protein, 19 aa, Artificial Sequence
  Description of Artificial Sequence: Synthetic peptide
  Seed: SRSYVPLAHSSSAFTITDQ (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFTITDQ

SEQ ID NO: 337459 - protein, 19 aa, Artificial Sequence
  Description of Artificial Sequence: Synthetic peptide
  Seed: SRSYVPLAHSSSAFTITDQ (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTITDQ

SEQ ID NO: 337460 - protein, 19 aa, Artificial Sequence
  Description of Artificial Sequence: Synthetic peptide
  Seed: SRSYVPLAHSSSAFTITDQ (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXITDQ

SEQ ID NO: 337461 - protein, 19 aa, Artificial Sequence
  Description of Artificial Sequence: Synthetic peptide
  Seed: SRSYVPLAHSSSAFTITDQ (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTXTDQ

SEQ ID NO: 337462 - protein, 19 aa, Artificial Sequence
  Description of Artificial Sequence: Synthetic peptide
  Seed: SRSYVPLAHSSSAFTITDQ (PMEL_HUMAN)
  Core: HSSSAFTIT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAXSSXAXTIXDQ

SEQ ID NO: 337463 - protein, 20 aa, Artificial Sequence
  Description of Artificial Sequence: Synthetic peptide
  Seed: SRSYVPLAHSSSAFTITDQV (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFTITDQV

SEQ ID NO: 337464 - protein, 20 aa, Artificial Sequence
  Description of Artificial Sequence: Synthetic peptide
  Seed: SRSYVPLAHSSSAFTITDQV (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTITDQV

SEQ ID NO: 337465 - protein, 20 aa, Artificial Sequence
  Description of Artificial Sequence: Synthetic peptide
  Seed: SRSYVPLAHSSSAFTITDQV (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXITDQV

SEQ ID NO: 337466 - protein, 20 aa, Artificial Sequence
  Description of Artificial Sequence: Synthetic peptide
  Seed: SRSYVPLAHSSSAFTITDQV (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTXTDQV

SEQ ID NO: 337467 - protein, 20 aa, Artificial Sequence
  Description of Artificial Sequence: Synthetic peptide
  Seed: SRSYVPLAHSSSAFTITDQV (PMEL_HUMAN)
  Core: HSSSAFTIT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAXSSXAXTIXDQV

SEQ ID NO: 337468 - protein, 21 aa, Artificial Sequence
  Description of Artificial Sequence: Synthetic peptide
  Seed: SRSYVPLAHSSSAFTITDQVP (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFTITDQVP

SEQ ID NO: 337469 - protein, 21 aa, Artificial Sequence
  Description of Artificial Sequence: Synthetic peptide
  Seed: SRSYVPLAHSSSAFTITDQVP (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTITDQVP

SEQ ID NO: 337470 - protein, 21 aa, Artificial Sequence
  Description of Artificial Sequence: Synthetic peptide
  Seed: SRSYVPLAHSSSAFTITDQVP (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXITDQVP

SEQ ID NO: 337471 - protein, 21 aa, Artificial Sequence
  Description of Artificial Sequence: Synthetic peptide
  Seed: SRSYVPLAHSSSAFTITDQVP (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTXTDQVP

SEQ ID NO: 337472 - protein, 21 aa, Artificial Sequence
  Description of Artificial Sequence: Synthetic peptide
  Seed: SRSYVPLAHSSSAFTITDQVP (PMEL_HUMAN)
  Core: HSSSAFTIT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAXSSXAXTIXDQVP

SEQ ID NO: 337473 - protein, 21 aa, Artificial Sequence
  Description of Artificial Sequence: Synthetic peptide
  Seed: SRSYVPLAHSSSAFTITDQVP (PMEL_HUMAN)
  Core: SSSAFTITD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHXSSXFXITXQVP

SEQ ID NO: 337474 - protein, 21 aa, Artificial Sequence
  Description of Artificial Sequence: Synthetic peptide
  Seed: SRSYVPLAHSSSAFTITDQVP (PMEL_HUMAN)
  Core: SSAFTITDQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSXSAXTXTDXVP

SEQ ID NO: 337475 - protein, 22 aa, Artificial Sequence
  Description of Artificial Sequence: Synthetic peptide
  Seed: SRSYVPLAHSSSAFTITDQVPF (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFTITDQVPF

SEQ ID NO: 337476 - protein, 22 aa, Artificial Sequence
  Description of Artificial Sequence: Synthetic peptide
  Seed: SRSYVPLAHSSSAFTITDQVPF (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTITDQVPF

SEQ ID NO: 337477 - protein, 22 aa, Artificial Sequence
  Description of Artificial Sequence: Synthetic peptide
  Seed: SRSYVPLAHSSSAFTITDQVPF (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXITDQVPF

SEQ ID NO: 337478 - protein, 22 aa, Artificial Sequence
  Description of Artificial Sequence: Synthetic peptide
  Seed: SRSYVPLAHSSSAFTITDQVPF (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTXTDQVPF

SEQ ID NO: 337479 - protein, 22 aa, Artificial Sequence
  Description of Artificial Sequence: Synthetic peptide
  Seed: SRSYVPLAHSSSAFTITDQVPF (PMEL_HUMAN)
  Core: HSSSAFTIT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAXSSXAXTIXDQVPF

SEQ ID NO: 337480 - protein, 22 aa, Artificial Sequence
  Description of Artificial Sequence: Synthetic peptide
  Seed: SRSYVPLAHSSSAFTITDQVPF (PMEL_HUMAN)
  Core: SSAFTITDQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSXSAXTXTDXVPF

SEQ ID NO: 337481 - protein, 22 aa, Artificial Sequence
  Description of Artificial Sequence: Synthetic peptide
  Seed: SRSYVPLAHSSSAFTITDQVPF (PMEL_HUMAN)
  Core: SAFTITDQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSSXAFXIXDQXPF

SEQ ID NO: 337482 - protein, 23 aa, Artificial Sequence
  Description of Artificial Sequence: Synthetic peptide
  Seed: SRSYVPLAHSSSAFTITDQVPFS (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFTITDQVPFS

SEQ ID NO: 337483 - protein, 23 aa, Artificial Sequence
  Description of Artificial Sequence: Synthetic peptide
  Seed: SRSYVPLAHSSSAFTITDQVPFS (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTITDQVPFS

SEQ ID NO: 337484 - protein, 23 aa, Artificial Sequence
  Description of Artificial Sequence: Synthetic peptide
  Seed: SRSYVPLAHSSSAFTITDQVPFS (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXITDQVPFS

SEQ ID NO: 337485 - protein, 23 aa, Artificial Sequence
  Description of Artificial Sequence: Synthetic peptide
  Seed: SRSYVPLAHSSSAFTITDQVPFS (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTXTDQVPFS

SEQ ID NO: 337486 - protein, 23 aa, Artificial Sequence
  Description of Artificial Sequence: Synthetic peptide
  Seed: SRSYVPLAHSSSAFTITDQVPFS (PMEL_HUMAN)
  Core: HSSSAFTIT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAXSSXAXTIXDQVPFS

SEQ ID NO: 337487 - protein, 23 aa, Artificial Sequence
  Description of Artificial Sequence: Synthetic peptide
  Seed: SRSYVPLAHSSSAFTITDQVPFS (PMEL_HUMAN)
  Core: SSAFTITDQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSXSAXTXTDXVPFS

SEQ ID NO: 337488 - protein, 23 aa, Artificial Sequence
  Description of Artificial Sequence: Synthetic peptide
  Seed: SRSYVPLAHSSSAFTITDQVPFS (PMEL_HUMAN)
  Core: SAFTITDQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSSXAFXIXDQXPFS

SEQ ID NO: 337489 - protein, 23 aa, Artificial Sequence
  Description of Artificial Sequence: Synthetic peptide
  Seed: SRSYVPLAHSSSAFTITDQVPFS (PMEL_HUMAN)
  Core: FTITDQVPF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSSSAXTIXDXVPXS

SEQ ID NO: 337490 - protein, 24 aa, Artificial Sequence
  Description of Artificial Sequence: Synthetic peptide
  Seed: SRSYVPLAHSSSAFTITDQVPFSV (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFTITDQVPFSV

SEQ ID NO: 337491 - protein, 24 aa, Artificial Sequence
  Description of Artificial Sequence: Synthetic peptide
  Seed: SRSYVPLAHSSSAFTITDQVPFSV (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTITDQVPFSV

SEQ ID NO: 337492 - protein, 24 aa, Artificial Sequence
  Description of Artificial Sequence: Synthetic peptide
  Seed: SRSYVPLAHSSSAFTITDQVPFSV (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXITDQVPFSV

SEQ ID NO: 337493 - protein, 24 aa, Artificial Sequence
  Description of Artificial Sequence: Synthetic peptide
  Seed: SRSYVPLAHSSSAFTITDQVPFSV (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTXTDQVPFSV

SEQ ID NO: 337494 - protein, 24 aa, Artificial Sequence
  Description of Artificial Sequence: Synthetic peptide
  Seed: SRSYVPLAHSSSAFTITDQVPFSV (PMEL_HUMAN)
  Core: HSSSAFTIT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAXSSXAXTIXDQVPFSV

SEQ ID NO: 337495 - protein, 24 aa, Artificial Sequence
  Description of Artificial Sequence: Synthetic peptide
  Seed: SRSYVPLAHSSSAFTITDQVPFSV (PMEL_HUMAN)
  Core: SSAFTITDQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSXSAXTXTDXVPFSV

SEQ ID NO: 337496 - protein, 24 aa, Artificial Sequence
  Description of Artificial Sequence: Synthetic peptide
  Seed: SRSYVPLAHSSSAFTITDQVPFSV (PMEL_HUMAN)
  Core: SAFTITDQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSSXAFXIXDQXPFSV

SEQ ID NO: 337497 - protein, 24 aa, Artificial Sequence
  Description of Artificial Sequence: Synthetic peptide
  Seed: SRSYVPLAHSSSAFTITDQVPFSV (PMEL_HUMAN)
  Core: FTITDQVPF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSSSAXTIXDXVPXSV

SEQ ID NO: 337498 - protein, 25 aa, Artificial Sequence
  Description of Artificial Sequence: Synthetic peptide
  Seed: SRSYVPLAHSSSAFTITDQVPFSVS (PMEL_HUMAN)
  Core: RSYVPLAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSYXPXAHXSSAFTITDQVPFSVS

SEQ ID NO: 337499 - protein, 25 aa, Artificial Sequence
  Description of Artificial Sequence: Synthetic peptide
  Seed: SRSYVPLAHSSSAFTITDQVPFSVS (PMEL_HUMAN)
  Core: YVPLAHSSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SRSXVPXAXSSXAFTITDQVPFSVS

SEQ ID NO: 337500 - protein, 25 aa, Artificial Sequence
  Description of Artificial Sequence: Synthetic peptide
  Seed: SRSYVPLAHSSSAFTITDQVPFSVS (PMEL_HUMAN)
  Core: LAHSSSAFT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPXAHXSXAFXITDQVPFSVS

SEQ ID NO: 337501 - protein, 25 aa, Artificial Sequence
  Description of Artificial Sequence: Synthetic peptide
  Seed: SRSYVPLAHSSSAFTITDQVPFSVS (PMEL_HUMAN)
  Core: AHSSSAFTI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLXHSXSXFTXTDQVPFSVS

SEQ ID NO: 337502 - protein, 25 aa, Artificial Sequence
  Description of Artificial Sequence: Synthetic peptide
  Seed: SRSYVPLAHSSSAFTITDQVPFSVS (PMEL_HUMAN)
  Core: HSSSAFTIT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAXSSXAXTIXDQVPFSVS

SEQ ID NO: 337503 - protein, 25 aa, Artificial Sequence
  Description of Artificial Sequence: Synthetic peptide
  Seed: SRSYVPLAHSSSAFTITDQVPFSVS (PMEL_HUMAN)
  Core: SSAFTITDQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSXSAXTXTDXVPFSVS

SEQ ID NO: 337504 - protein, 25 aa, Artificial Sequence
  Description of Artificial Sequence: Synthetic peptide
  Seed: SRSYVPLAHSSSAFTITDQVPFSVS (PMEL_HUMAN)
  Core: SAFTITDQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSSXAFXIXDQXPFSVS

SEQ ID NO: 337505 - protein, 25 aa, Artificial Sequence
  Description of Artificial Sequence: Synthetic peptide
  Seed: SRSYVPLAHSSSAFTITDQVPFSVS (PMEL_HUMAN)
  Core: FTITDQVPF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SRSYVPLAHSSSAXTIXDXVPXSVS

SEQ ID NO: 337506 - protein, 14 aa, Artificial Sequence
  Description of Artificial Sequence: Synthetic peptide
  Seed: SSAFTITDQVPFSV (PMEL_HUMAN)
  Core: AFTITDQVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXFTXTXQVXFSV

SEQ ID NO: 337507 - protein, 14 aa, Artificial Sequence
  Description of Artificial Sequence: Synthetic peptide
  Seed: SSAFTITDQVPFSV (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSV

SEQ ID NO: 337508 - protein, 15 aa, Artificial Sequence
  Description of Artificial Sequence: Synthetic peptide
  Seed: SSAFTITDQVPFSVS (PMEL_HUMAN)
  Core: AFTITDQVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXFTXTXQVXFSVS

SEQ ID NO: 337509 - protein, 15 aa, Artificial Sequence
  Description of Artificial Sequence: Synthetic peptide
  Seed: SSAFTITDQVPFSVS (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVS

SEQ ID NO: 337510 - protein, 15 aa, Artificial Sequence
  Description of Artificial Sequence: Synthetic peptide
  Seed: SSAFTITDQVPFSVS (PMEL_HUMAN)
  Core: TITDQVPFS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSAFXITXQXPFXVS

SEQ ID NO: 337511 - protein, 15 aa, Artificial Sequence
  Description of Artificial Sequence: Synthetic peptide
  Seed: SSAFTITDQVPFSVS (PMEL_HUMAN)
  Core: ITDQVPFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTXTDXVXFSXS

SEQ ID NO: 337512 - protein, 16 aa, Artificial Sequence
  Description of Artificial Sequence: Synthetic peptide
  Seed: SSAFTITDQVPFSVSV (PMEL_HUMAN)
  Core: AFTITDQVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXFTXTXQVXFSVSV

SEQ ID NO: 337513 - protein, 16 aa, Artificial Sequence
  Description of Artificial Sequence: Synthetic peptide
  Seed: SSAFTITDQVPFSVSV (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSV

SEQ ID NO: 337514 - protein, 16 aa, Artificial Sequence
  Description of Artificial Sequence: Synthetic peptide
  Seed: SSAFTITDQVPFSVSV (PMEL_HUMAN)
  Core: ITDQVPFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTXTDXVXFSXSV

SEQ ID NO: 337515 - protein, 17 aa, Artificial Sequence
  Description of Artificial Sequence: Synthetic peptide
  Seed: SSAFTITDQVPFSVSVS (PMEL_HUMAN)
  Core: AFTITDQVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXFTXTXQVXFSVSVS

SEQ ID NO: 337516 - protein, 17 aa, Artificial Sequence
  Description of Artificial Sequence: Synthetic peptide
  Seed: SSAFTITDQVPFSVSVS (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSVS

SEQ ID NO: 337517 - protein, 17 aa, Artificial Sequence
  Description of Artificial Sequence: Synthetic peptide
  Seed: SSAFTITDQVPFSVSVS (PMEL_HUMAN)
  Core: ITDQVPFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTXTDXVXFSXSVS

SEQ ID NO: 337518 - protein, 18 aa, Artificial Sequence
  Description of Artificial Sequence: Synthetic peptide
  Seed: SSAFTITDQVPFSVSVSQ (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSVSQ

SEQ ID NO: 337519 - protein, 18 aa, Artificial Sequence
  Description of Artificial Sequence: Synthetic peptide
  Seed: SSAFTITDQVPFSVSVSQ (PMEL_HUMAN)
  Core: ITDQVPFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTXTDXVXFSXSVSQ

SEQ ID NO: 337520 - protein, 19 aa, Artificial Sequence
  Description of Artificial Sequence: Synthetic peptide
  Seed: SSAFTITDQVPFSVSVSQL (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSVSQL

SEQ ID NO: 337521 - protein, 19 aa, Artificial Sequence
  Description of Artificial Sequence: Synthetic peptide
  Seed: SSAFTITDQVPFSVSVSQL (PMEL_HUMAN)
  Core: ITDQVPFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTXTDXVXFSXSVSQL

SEQ ID NO: 337522 - protein, 19 aa, Artificial Sequence
  Description of Artificial Sequence: Synthetic peptide
  Seed: SSAFTITDQVPFSVSVSQL (PMEL_HUMAN)
  Core: QVPFSVSVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDXVPXSXSVXQL

SEQ ID NO: 337523 - protein, 19 aa, Artificial Sequence
  Description of Artificial Sequence: Synthetic peptide
  Seed: SSAFTITDQVPFSVSVSQL (PMEL_HUMAN)
  Core: PFSVSVSQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVXFSXSXSQX

SEQ ID NO: 337524 - protein, 20 aa, Artificial Sequence
  Description of Artificial Sequence: Synthetic peptide
  Seed: SSAFTITDQVPFSVSVSQLR (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSVSQLR

SEQ ID NO: 337525 - protein, 20 aa, Artificial Sequence
  Description of Artificial Sequence: Synthetic peptide
  Seed: SSAFTITDQVPFSVSVSQLR (PMEL_HUMAN)
  Core: ITDQVPFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTXTDXVXFSXSVSQLR

SEQ ID NO: 337526 - protein, 20 aa, Artificial Sequence
  Description of Artificial Sequence: Synthetic peptide
  Seed: SSAFTITDQVPFSVSVSQLR (PMEL_HUMAN)
  Core: QVPFSVSVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDXVPXSXSVXQLR

SEQ ID NO: 337527 - protein, 20 aa, Artificial Sequence
  Description of Artificial Sequence: Synthetic peptide
  Seed: SSAFTITDQVPFSVSVSQLR (PMEL_HUMAN)
  Core: PFSVSVSQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVXFSXSXSQXR

SEQ ID NO: 337528 - protein, 21 aa, Artificial Sequence
  Description of Artificial Sequence: Synthetic peptide
  Seed: SSAFTITDQVPFSVSVSQLRA (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSVSQLRA

SEQ ID NO: 337529 - protein, 21 aa, Artificial Sequence
  Description of Artificial Sequence: Synthetic peptide
  Seed: SSAFTITDQVPFSVSVSQLRA (PMEL_HUMAN)
  Core: ITDQVPFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTXTDXVXFSXSVSQLRA

SEQ ID NO: 337530 - protein, 21 aa, Artificial Sequence
  Description of Artificial Sequence: Synthetic peptide
  Seed: SSAFTITDQVPFSVSVSQLRA (PMEL_HUMAN)
  Core: QVPFSVSVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDXVPXSXSVXQLRA

SEQ ID NO: 337531 - protein, 21 aa, Artificial Sequence
  Description of Artificial Sequence: Synthetic peptide
  Seed: SSAFTITDQVPFSVSVSQLRA (PMEL_HUMAN)
  Core: PFSVSVSQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVXFSXSXSQXRA

SEQ ID NO: 337532 - protein, 21 aa, Artificial Sequence
  Description of Artificial Sequence: Synthetic peptide
  Seed: SSAFTITDQVPFSVSVSQLRA (PMEL_HUMAN)
  Core: FSVSVSQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPXSVXVXQLXA

SEQ ID NO: 337533 - protein, 22 aa, Artificial Sequence
  Description of Artificial Sequence: Synthetic peptide
  Seed: SSAFTITDQVPFSVSVSQLRAL (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSVSQLRAL

SEQ ID NO: 337534 - protein, 22 aa, Artificial Sequence
  Description of Artificial Sequence: Synthetic peptide
  Seed: SSAFTITDQVPFSVSVSQLRAL (PMEL_HUMAN)
  Core: ITDQVPFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTXTDXVXFSXSVSQLRAL

SEQ ID NO: 337535 - protein, 22 aa, Artificial Sequence
  Description of Artificial Sequence: Synthetic peptide
  Seed: SSAFTITDQVPFSVSVSQLRAL (PMEL_HUMAN)
  Core: QVPFSVSVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDXVPXSXSVXQLRAL

SEQ ID NO: 337536 - protein, 22 aa, Artificial Sequence
  Description of Artificial Sequence: Synthetic peptide
  Seed: SSAFTITDQVPFSVSVSQLRAL (PMEL_HUMAN)
  Core: PFSVSVSQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVXFSXSXSQXRAL

SEQ ID NO: 337537 - protein, 22 aa, Artificial Sequence
  Description of Artificial Sequence: Synthetic peptide
  Seed: SSAFTITDQVPFSVSVSQLRAL (PMEL_HUMAN)
  Core: FSVSVSQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPXSVXVXQLXAL

SEQ ID NO: 337538 - protein, 22 aa, Artificial Sequence
  Description of Artificial Sequence: Synthetic peptide
  Seed: SSAFTITDQVPFSVSVSQLRAL (PMEL_HUMAN)
  Core: VSVSQLRAL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPFSXSVXQXRAX

SEQ ID NO: 337539 - protein, 23 aa, Artificial Sequence
  Description of Artificial Sequence: Synthetic peptide
  Seed: SSAFTITDQVPFSVSVSQLRALD (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSVSQLRALD

SEQ ID NO: 337540 - protein, 23 aa, Artificial Sequence
  Description of Artificial Sequence: Synthetic peptide
  Seed: SSAFTITDQVPFSVSVSQLRALD (PMEL_HUMAN)
  Core: QVPFSVSVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDXVPXSXSVXQLRALD

SEQ ID NO: 337541 - protein, 23 aa, Artificial Sequence
  Description of Artificial Sequence: Synthetic peptide
  Seed: SSAFTITDQVPFSVSVSQLRALD (PMEL_HUMAN)
  Core: PFSVSVSQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVXFSXSXSQXRALD

SEQ ID NO: 337542 - protein, 23 aa, Artificial Sequence
  Description of Artificial Sequence: Synthetic peptide
  Seed: SSAFTITDQVPFSVSVSQLRALD (PMEL_HUMAN)
  Core: FSVSVSQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPXSVXVXQLXALD

SEQ ID NO: 337543 - protein, 23 aa, Artificial Sequence
  Description of Artificial Sequence: Synthetic peptide
  Seed: SSAFTITDQVPFSVSVSQLRALD (PMEL_HUMAN)
  Core: VSVSQLRAL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPFSXSVXQXRAXD

SEQ ID NO: 337544 - protein, 24 aa, Artificial Sequence
  Description of Artificial Sequence: Synthetic peptide
  Seed: SSAFTITDQVPFSVSVSQLRALDG (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSVSQLRALDG

SEQ ID NO: 337545 - protein, 24 aa, Artificial Sequence
  Description of Artificial Sequence: Synthetic peptide
  Seed: SSAFTITDQVPFSVSVSQLRALDG (PMEL_HUMAN)
  Core: ITDQVPFSV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTXTDXVXFSXSVSQLRALDG

SEQ ID NO: 337546 - protein, 24 aa, Artificial Sequence
  Description of Artificial Sequence: Synthetic peptide
  Seed: SSAFTITDQVPFSVSVSQLRALDG (PMEL_HUMAN)
  Core: QVPFSVSVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDXVPXSXSVXQLRALDG

SEQ ID NO: 337547 - protein, 24 aa, Artificial Sequence
  Description of Artificial Sequence: Synthetic peptide
  Seed: SSAFTITDQVPFSVSVSQLRALDG (PMEL_HUMAN)
  Core: PFSVSVSQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVXFSXSXSQXRALDG

SEQ ID NO: 337548 - protein, 24 aa, Artificial Sequence
  Description of Artificial Sequence: Synthetic peptide
  Seed: SSAFTITDQVPFSVSVSQLRALDG (PMEL_HUMAN)
  Core: FSVSVSQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPXSVXVXQLXALDG

SEQ ID NO: 337549 - protein, 24 aa, Artificial Sequence
  Description of Artificial Sequence: Synthetic peptide
  Seed: SSAFTITDQVPFSVSVSQLRALDG (PMEL_HUMAN)
  Core: VSVSQLRAL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPFSXSVXQXRAXDG

SEQ ID NO: 337550 - protein, 25 aa, Artificial Sequence
  Description of Artificial Sequence: Synthetic peptide
  Seed: SSAFTITDQVPFSVSVSQLRALDGG (PMEL_HUMAN)
  Core: FTITDQVPF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSAXTIXDXVPXSVSVSQLRALDGG

SEQ ID NO: 337551 - protein, 25 aa, Artificial Sequence
  Description of Artificial Sequence: Synthetic peptide
  Seed: SSAFTITDQVPFSVSVSQLRALDGG (PMEL_HUMAN)
  Core: QVPFSVSVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDXVPXSXSVXQLRALDGG

SEQ ID NO: 337552 - protein, 25 aa, Artificial Sequence
  Description of Artificial Sequence: Synthetic peptide
  Seed: SSAFTITDQVPFSVSVSQLRALDGG (PMEL_HUMAN)
  Core: PFSVSVSQL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVXFSXSXSQXRALDGG

SEQ ID NO: 337553 - protein, 25 aa, Artificial Sequence
  Description of Artificial Sequence: Synthetic peptide
  Seed: SSAFTITDQVPFSVSVSQLRALDGG (PMEL_HUMAN)
  Core: FSVSVSQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPXSVXVXQLXALDGG

SEQ ID NO: 337554 - protein, 25 aa, Artificial Sequence
  Description of Artificial Sequence: Synthetic peptide
  Seed: SSAFTITDQVPFSVSVSQLRALDGG (PMEL_HUMAN)
  Core: VSVSQLRAL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPFSXSVXQXRAXDGG

SEQ ID NO: 337555 - protein, 25 aa, Artificial Sequence
  Description of Artificial Sequence: Synthetic peptide
  Seed: SSAFTITDQVPFSVSVSQLRALDGG (PMEL_HUMAN)
  Core: VSQLRALDG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SSAFTITDQVPFSVSXSQXRXLDXG

SEQ ID NO: 337556 - protein, 13 aa, Artificial Sequence
  Description of Artificial Sequence: Synthetic peptide
  Seed: SSGTLISRALVVT (PMEL_HUMAN)
  Core: TLISRALVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSGXLIXRXLVXT

SEQ ID NO: 337557 - protein, 14 aa, Artificial Sequence
  Description of Artificial Sequence: Synthetic peptide
  Seed: SSGTLISRALVVTH (PMEL_HUMAN)
  Core: GTLISRALV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXTLXSXALXVTH

SEQ ID NO: 337558 - protein, 14 aa, Artificial Sequence
  Description of Artificial Sequence: Synthetic peptide
  Seed: SSGTLISRALVVTH (PMEL_HUMAN)
  Core: TLISRALVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSGXLIXRXLVXTH

SEQ ID NO: 337559 - protein, 14 aa, Artificial Sequence
  Description of Artificial Sequence: Synthetic peptide
  Seed: SSGTLISRALVVTH (PMEL_HUMAN)
  Core: LISRALVVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSGTXISXAXVVXH

SEQ ID NO: 337560 - protein, 14 aa, Artificial Sequence
  Description of Artificial Sequence: Synthetic peptide
  Seed: SSGTLISRALVVTH (PMEL_HUMAN)
  Core: ISRALVVTH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLXSRXLXVTX

SEQ ID NO: 337561 - protein, 15 aa, Artificial Sequence
  Description of Artificial Sequence: Synthetic peptide
  Seed: SSGTLISRALVVTHT (PMEL_HUMAN)
  Core: GTLISRALV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXTLXSXALXVTHT

SEQ ID NO: 337562 - protein, 15 aa, Artificial Sequence
  Description of Artificial Sequence: Synthetic peptide
  Seed: SSGTLISRALVVTHT (PMEL_HUMAN)
  Core: TLISRALVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSGXLIXRXLVXTHT

SEQ ID NO: 337563 - protein, 15 aa, Artificial Sequence
  Description of Artificial Sequence: Synthetic peptide
  Seed: SSGTLISRALVVTHT (PMEL_HUMAN)
  Core: LISRALVVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSGTXISXAXVVXHT

SEQ ID NO: 337564 - protein, 15 aa, Artificial Sequence
  Description of Artificial Sequence: Synthetic peptide
  Seed: SSGTLISRALVVTHT (PMEL_HUMAN)
  Core: ISRALVVTH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLXSRXLXVTXT

SEQ ID NO: 337565 - protein, 16 aa, Artificial Sequence
  Description of Artificial Sequence: Synthetic peptide
  Seed: SSGTLISRALVVTHTY (PMEL_HUMAN)
  Core: GTLISRALV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXTLXSXALXVTHTY

SEQ ID NO: 337566 - protein, 16 aa, Artificial Sequence
  Description of Artificial Sequence: Synthetic peptide
  Seed: SSGTLISRALVVTHTY (PMEL_HUMAN)
  Core: TLISRALVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSGXLIXRXLVXTHTY

SEQ ID NO: 337567 - protein, 16 aa, Artificial Sequence
  Description of Artificial Sequence: Synthetic peptide
  Seed: SSGTLISRALVVTHTY (PMEL_HUMAN)
  Core: LISRALVVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSGTXISXAXVVXHTY

SEQ ID NO: 337568 - protein, 16 aa, Artificial Sequence
  Description of Artificial Sequence: Synthetic peptide
  Seed: SSGTLISRALVVTHTY (PMEL_HUMAN)
  Core: ISRALVVTH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLXSRXLXVTXTY

SEQ ID NO: 337569 - protein, 16 aa, Artificial Sequence
  Description of Artificial Sequence: Synthetic peptide
  Seed: SSGTLISRALVVTHTY (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXY

SEQ ID NO: 337570 - protein, 17 aa, Artificial Sequence
  Description of Artificial Sequence: Synthetic peptide
  Seed: SSGTLISRALVVTHTYL (PMEL_HUMAN)
  Core: GTLISRALV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXTLXSXALXVTHTYL

SEQ ID NO: 337571 - protein, 17 aa, Artificial Sequence
  Description of Artificial Sequence: Synthetic peptide
  Seed: SSGTLISRALVVTHTYL (PMEL_HUMAN)
  Core: TLISRALVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSGXLIXRXLVXTHTYL

SEQ ID NO: 337572 - protein, 17 aa, Artificial Sequence
  Description of Artificial Sequence: Synthetic peptide
  Seed: SSGTLISRALVVTHTYL (PMEL_HUMAN)
  Core: LISRALVVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSGTXISXAXVVXHTYL

SEQ ID NO: 337573 - protein, 17 aa, Artificial Sequence
  Description of Artificial Sequence: Synthetic peptide
  Seed: SSGTLISRALVVTHTYL (PMEL_HUMAN)
  Core: ISRALVVTH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLXSRXLXVTXTYL

SEQ ID NO: 337574 - protein, 17 aa, Artificial Sequence
  Description of Artificial Sequence: Synthetic peptide
  Seed: SSGTLISRALVVTHTYL (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXYL

SEQ ID NO: 337575 - protein, 17 aa, Artificial Sequence
  Description of Artificial Sequence: Synthetic peptide
  Seed: SSGTLISRALVVTHTYL (PMEL_HUMAN)
  Core: RALVVTHTY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISXALXVXHTXL

SEQ ID NO: 337576 - protein, 18 aa, Artificial Sequence
  Description of Artificial Sequence: Synthetic peptide
  Seed: SSGTLISRALVVTHTYLE (PMEL_HUMAN)
  Core: TLISRALVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSGXLIXRXLVXTHTYLE

SEQ ID NO: 337577 - protein, 18 aa, Artificial Sequence
  Description of Artificial Sequence: Synthetic peptide
  Seed: SSGTLISRALVVTHTYLE (PMEL_HUMAN)
  Core: LISRALVVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSGTXISXAXVVXHTYLE

SEQ ID NO: 337578 - protein, 18 aa, Artificial Sequence
  Description of Artificial Sequence: Synthetic peptide
  Seed: SSGTLISRALVVTHTYLE (PMEL_HUMAN)
  Core: ISRALVVTH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLXSRXLXVTXTYLE

SEQ ID NO: 337579 - protein, 18 aa, Artificial Sequence
  Description of Artificial Sequence: Synthetic peptide
  Seed: SSGTLISRALVVTHTYLE (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXYLE

SEQ ID NO: 337580 - protein, 18 aa, Artificial Sequence
  Description of Artificial Sequence: Synthetic peptide
  Seed: SSGTLISRALVVTHTYLE (PMEL_HUMAN)
  Core: RALVVTHTY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISXALXVXHTXLE

SEQ ID NO: 337581 - protein, 19 aa, Artificial Sequence
  Description of Artificial Sequence: Synthetic peptide
  Seed: SSGTLISRALVVTHTYLEP (PMEL_HUMAN)
  Core: TLISRALVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSGXLIXRXLVXTHTYLEP

SEQ ID NO: 337582 - protein, 19 aa, Artificial Sequence
  Description of Artificial Sequence: Synthetic peptide
  Seed: SSGTLISRALVVTHTYLEP (PMEL_HUMAN)
  Core: LISRALVVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSGTXISXAXVVXHTYLEP

SEQ ID NO: 337583 - protein, 19 aa, Artificial Sequence
  Description of Artificial Sequence: Synthetic peptide
  Seed: SSGTLISRALVVTHTYLEP (PMEL_HUMAN)
  Core: ISRALVVTH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLXSRXLXVTXTYLEP

SEQ ID NO: 337584 - protein, 19 aa, Artificial Sequence
  Description of Artificial Sequence: Synthetic peptide
  Seed: SSGTLISRALVVTHTYLEP (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXYLEP

SEQ ID NO: 337585 - protein, 19 aa, Artificial Sequence
  Description of Artificial Sequence: Synthetic peptide
  Seed: SSGTLISRALVVTHTYLEP (PMEL_HUMAN)
  Core: RALVVTHTY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISXALXVXHTXLEP

SEQ ID NO: 337586 - protein, 19 aa, Artificial Sequence
  Description of Artificial Sequence: Synthetic peptide
  Seed: SSGTLISRALVVTHTYLEP (PMEL_HUMAN)
  Core: LVVTHTYLE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRAXVVXHXYLXP

SEQ ID NO: 337587 - protein, 19 aa, Artificial Sequence
  Description of Artificial Sequence: Synthetic peptide
  Seed: SSGTLISRALVVTHTYLEP (PMEL_HUMAN)
  Core: VVTHTYLEP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALXVTXTXLEX

SEQ ID NO: 337588 - protein, 20 aa, Artificial Sequence
  Description of Artificial Sequence: Synthetic peptide
  Seed: SSGTLISRALVVTHTYLEPG (PMEL_HUMAN)
  Core: ISRALVVTH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLXSRXLXVTXTYLEPG

SEQ ID NO: 337589 - protein, 20 aa, Artificial Sequence
  Description of Artificial Sequence: Synthetic peptide
  Seed: SSGTLISRALVVTHTYLEPG (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXYLEPG

SEQ ID NO: 337590 - protein, 20 aa, Artificial Sequence
  Description of Artificial Sequence: Synthetic peptide
  Seed: SSGTLISRALVVTHTYLEPG (PMEL_HUMAN)
  Core: RALVVTHTY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISXALXVXHTXLEPG

SEQ ID NO: 337591 - protein, 20 aa, Artificial Sequence
  Description of Artificial Sequence: Synthetic peptide
  Seed: SSGTLISRALVVTHTYLEPG (PMEL_HUMAN)
  Core: LVVTHTYLE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRAXVVXHXYLXPG

SEQ ID NO: 337592 - protein, 20 aa, Artificial Sequence
  Description of Artificial Sequence: Synthetic peptide
  Seed: SSGTLISRALVVTHTYLEPG (PMEL_HUMAN)
  Core: VVTHTYLEP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALXVTXTXLEXG

SEQ ID NO: 337593 - protein, 21 aa, Artificial Sequence
  Description of Artificial Sequence: Synthetic peptide
  Seed: SSGTLISRALVVTHTYLEPGP (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXYLEPGP

SEQ ID NO: 337594 - protein, 21 aa, Artificial Sequence
  Description of Artificial Sequence: Synthetic peptide
  Seed: SSGTLISRALVVTHTYLEPGP (PMEL_HUMAN)
  Core: RALVVTHTY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISXALXVXHTXLEPGP

SEQ ID NO: 337595 - protein, 21 aa, Artificial Sequence
  Description of Artificial Sequence: Synthetic peptide
  Seed: SSGTLISRALVVTHTYLEPGP (PMEL_HUMAN)
  Core: LVVTHTYLE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRAXVVXHXYLXPGP

SEQ ID NO: 337596 - protein, 21 aa, Artificial Sequence
  Description of Artificial Sequence: Synthetic peptide
  Seed: SSGTLISRALVVTHTYLEPGP (PMEL_HUMAN)
  Core: VVTHTYLEP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALXVTXTXLEXGP

SEQ ID NO: 337597 - protein, 21 aa, Artificial Sequence
  Description of Artificial Sequence: Synthetic peptide
  Seed: SSGTLISRALVVTHTYLEPGP (PMEL_HUMAN)
  Core: VTHTYLEPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALVXTHXYXEPXP

SEQ ID NO: 337598 - protein, 22 aa, Artificial Sequence
  Description of Artificial Sequence: Synthetic peptide
  Seed: SSGTLISRALVVTHTYLEPGPV (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXYLEPGPV

SEQ ID NO: 337599 - protein, 22 aa, Artificial Sequence
  Description of Artificial Sequence: Synthetic peptide
  Seed: SSGTLISRALVVTHTYLEPGPV (PMEL_HUMAN)
  Core: RALVVTHTY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISXALXVXHTXLEPGPV

SEQ ID NO: 337600 - protein, 22 aa, Artificial Sequence
  Description of Artificial Sequence: Synthetic peptide
  Seed: SSGTLISRALVVTHTYLEPGPV (PMEL_HUMAN)
  Core: LVVTHTYLE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRAXVVXHXYLXPGPV

SEQ ID NO: 337601 - protein, 22 aa, Artificial Sequence
  Description of Artificial Sequence: Synthetic peptide
  Seed: SSGTLISRALVVTHTYLEPGPV (PMEL_HUMAN)
  Core: VVTHTYLEP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALXVTXTXLEXGPV

SEQ ID NO: 337602 - protein, 22 aa, Artificial Sequence
  Description of Artificial Sequence: Synthetic peptide
  Seed: SSGTLISRALVVTHTYLEPGPV (PMEL_HUMAN)
  Core: VTHTYLEPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALVXTHXYXEPXPV

SEQ ID NO: 337603 - protein, 23 aa, Artificial Sequence
  Description of Artificial Sequence: Synthetic peptide
  Seed: SSGTLISRALVVTHTYLEPGPVT (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXYLEPGPVT

SEQ ID NO: 337604 - protein, 23 aa, Artificial Sequence
  Description of Artificial Sequence: Synthetic peptide
  Seed: SSGTLISRALVVTHTYLEPGPVT (PMEL_HUMAN)
  Core: RALVVTHTY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISXALXVXHTXLEPGPVT

SEQ ID NO: 337605 - protein, 23 aa, Artificial Sequence
  Description of Artificial Sequence: Synthetic peptide
  Seed: SSGTLISRALVVTHTYLEPGPVT (PMEL_HUMAN)
  Core: LVVTHTYLE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRAXVVXHXYLXPGPVT

SEQ ID NO: 337606 - protein, 23 aa, Artificial Sequence
  Description of Artificial Sequence: Synthetic peptide
  Seed: SSGTLISRALVVTHTYLEPGPVT (PMEL_HUMAN)
  Core: VVTHTYLEP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALXVTXTXLEXGPVT

SEQ ID NO: 337607 - protein, 23 aa, Artificial Sequence
  Description of Artificial Sequence: Synthetic peptide
  Seed: SSGTLISRALVVTHTYLEPGPVT (PMEL_HUMAN)
  Core: VTHTYLEPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALVXTHXYXEPXPVT

SEQ ID NO: 337608 - protein, 24 aa, Artificial Sequence
  Description of Artificial Sequence: Synthetic peptide
  Seed: SSGTLISRALVVTHTYLEPGPVTA (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXYLEPGPVTA

SEQ ID NO: 337609 - protein, 24 aa, Artificial Sequence
  Description of Artificial Sequence: Synthetic peptide
  Seed: SSGTLISRALVVTHTYLEPGPVTA (PMEL_HUMAN)
  Core: RALVVTHTY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISXALXVXHTXLEPGPVTA

SEQ ID NO: 337610 - protein, 24 aa, Artificial Sequence
  Description of Artificial Sequence: Synthetic peptide
  Seed: SSGTLISRALVVTHTYLEPGPVTA (PMEL_HUMAN)
  Core: LVVTHTYLE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRAXVVXHXYLXPGPVTA

SEQ ID NO: 337611 - protein, 24 aa, Artificial Sequence
  Description of Artificial Sequence: Synthetic peptide
  Seed: SSGTLISRALVVTHTYLEPGPVTA (PMEL_HUMAN)
  Core: VVTHTYLEP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALXVTXTXLEXGPVTA

SEQ ID NO: 337612 - protein, 24 aa, Artificial Sequence
  Description of Artificial Sequence: Synthetic peptide
  Seed: SSGTLISRALVVTHTYLEPGPVTA (PMEL_HUMAN)
  Core: VTHTYLEPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALVXTHXYXEPXPVTA

SEQ ID NO: 337613 - protein, 25 aa, Artificial Sequence
  Description of Artificial Sequence: Synthetic peptide
  Seed: SSGTLISRALVVTHTYLEPGPVTAQ (PMEL_HUMAN)
  Core: SRALVVTHT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLIXRAXVXTHXYLEPGPVTAQ

SEQ ID NO: 337614 - protein, 25 aa, Artificial Sequence
  Description of Artificial Sequence: Synthetic peptide
  Seed: SSGTLISRALVVTHTYLEPGPVTAQ (PMEL_HUMAN)
  Core: RALVVTHTY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISXALXVXHTXLEPGPVTAQ

SEQ ID NO: 337615 - protein, 25 aa, Artificial Sequence
  Description of Artificial Sequence: Synthetic peptide
  Seed: SSGTLISRALVVTHTYLEPGPVTAQ (PMEL_HUMAN)
  Core: LVVTHTYLE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRAXVVXHXYLXPGPVTAQ

SEQ ID NO: 337616 - protein, 25 aa, Artificial Sequence
  Description of Artificial Sequence: Synthetic peptide
  Seed: SSGTLISRALVVTHTYLEPGPVTAQ (PMEL_HUMAN)
  Core: VVTHTYLEP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALXVTXTXLEXGPVTAQ

SEQ ID NO: 337617 - protein, 25 aa, Artificial Sequence
  Description of Artificial Sequence: Synthetic peptide
  Seed: SSGTLISRALVVTHTYLEPGPVTAQ (PMEL_HUMAN)
  Core: VTHTYLEPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALVXTHXYXEPXPVTAQ

SEQ ID NO: 337618 - protein, 25 aa, Artificial Sequence
  Description of Artificial Sequence: Synthetic peptide
  Seed: SSGTLISRALVVTHTYLEPGPVTAQ (PMEL_HUMAN)
  Core: HTYLEPGPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SSGTLISRALVVTXTYXEXGPXTAQ

SEQ ID NO: 337619 - protein, 14 aa, Artificial Sequence
  Description of Artificial Sequence: Synthetic peptide
  Seed: SSHWLRLPRIFCSC (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSC

SEQ ID NO: 337620 - protein, 15 aa, Artificial Sequence
  Description of Artificial Sequence: Synthetic peptide
  Seed: SSHWLRLPRIFCSCP (PMEL_HUMAN)
  Core: SHWLRLPRI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXHWXRXPRXFCSCP

SEQ ID NO: 337621 - protein, 15 aa, Artificial Sequence
  Description of Artificial Sequence: Synthetic peptide
  Seed: SSHWLRLPRIFCSCP (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCP

SEQ ID NO: 337622 - protein, 15 aa, Artificial Sequence
  Description of Artificial Sequence: Synthetic peptide
  Seed: SSHWLRLPRIFCSCP (PMEL_HUMAN)
  Core: LRLPRIFCS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSHWXRLXRXFCXCP

SEQ ID NO: 337623 - protein, 16 aa, Artificial Sequence
  Description of Artificial Sequence: Synthetic peptide
  Seed: SSHWLRLPRIFCSCPI (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCPI

SEQ ID NO: 337624 - protein, 16 aa, Artificial Sequence
  Description of Artificial Sequence: Synthetic peptide
  Seed: SSHWLRLPRIFCSCPI (PMEL_HUMAN)
  Core: LRLPRIFCS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSHWXRLXRXFCXCPI

SEQ ID NO: 337625 - protein, 16 aa, Artificial Sequence
  Description of Artificial Sequence: Synthetic peptide
  Seed: SSHWLRLPRIFCSCPI (PMEL_HUMAN)
  Core: RLPRIFCSC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLXLPXIXCSXPI

SEQ ID NO: 337626 - protein, 16 aa, Artificial Sequence
  Description of Artificial Sequence: Synthetic peptide
  Seed: SSHWLRLPRIFCSCPI (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPX

SEQ ID NO: 337627 - protein, 17 aa, Artificial Sequence
  Description of Artificial Sequence: Synthetic peptide
  Seed: SSHWLRLPRIFCSCPIG (PMEL_HUMAN)
  Core: SHWLRLPRI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXHWXRXPRXFCSCPIG

SEQ ID NO: 337628 - protein, 17 aa, Artificial Sequence
  Description of Artificial Sequence: Synthetic peptide
  Seed: SSHWLRLPRIFCSCPIG (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCPIG

SEQ ID NO: 337629 - protein, 17 aa, Artificial Sequence
  Description of Artificial Sequence: Synthetic peptide
  Seed: SSHWLRLPRIFCSCPIG (PMEL_HUMAN)
  Core: LRLPRIFCS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSHWXRLXRXFCXCPIG

SEQ ID NO: 337630 - protein, 17 aa, Artificial Sequence
  Description of Artificial Sequence: Synthetic peptide
  Seed: SSHWLRLPRIFCSCPIG (PMEL_HUMAN)
  Core: RLPRIFCSC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLXLPXIXCSXPIG

SEQ ID NO: 337631 - protein, 17 aa, Artificial Sequence
  Description of Artificial Sequence: Synthetic peptide
  Seed: SSHWLRLPRIFCSCPIG (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPXG

SEQ ID NO: 337632 - protein, 18 aa, Artificial Sequence
  Description of Artificial Sequence: Synthetic peptide
  Seed: SSHWLRLPRIFCSCPIGE (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPXGE

SEQ ID NO: 337633 - protein, 19 aa, Artificial Sequence
  Description of Artificial Sequence: Synthetic peptide
  Seed: SSHWLRLPRIFCSCPIGEN (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCPIGEN

SEQ ID NO: 337634 - protein, 19 aa, Artificial Sequence
  Description of Artificial Sequence: Synthetic peptide
  Seed: SSHWLRLPRIFCSCPIGEN (PMEL_HUMAN)
  Core: RLPRIFCSC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLXLPXIXCSXPIGEN

SEQ ID NO: 337635 - protein, 19 aa, Artificial Sequence
  Description of Artificial Sequence: Synthetic peptide
  Seed: SSHWLRLPRIFCSCPIGEN (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPXGEN

SEQ ID NO: 337636 - protein, 19 aa, Artificial Sequence
  Description of Artificial Sequence: Synthetic peptide
  Seed: SSHWLRLPRIFCSCPIGEN (PMEL_HUMAN)
  Core: FCSCPIGEN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRIXCSXPXGEX

SEQ ID NO: 337637 - protein, 20 aa, Artificial Sequence
  Description of Artificial Sequence: Synthetic peptide
  Seed: SSHWLRLPRIFCSCPIGENS (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCPIGENS

SEQ ID NO: 337638 - protein, 20 aa, Artificial Sequence
  Description of Artificial Sequence: Synthetic peptide
  Seed: SSHWLRLPRIFCSCPIGENS (PMEL_HUMAN)
  Core: RLPRIFCSC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLXLPXIXCSXPIGENS

SEQ ID NO: 337639 - protein, 20 aa, Artificial Sequence
  Description of Artificial Sequence: Synthetic peptide
  Seed: SSHWLRLPRIFCSCPIGENS (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPXGENS

SEQ ID NO: 337640 - protein, 20 aa, Artificial Sequence
  Description of Artificial Sequence: Synthetic peptide
  Seed: SSHWLRLPRIFCSCPIGENS (PMEL_HUMAN)
  Core: RIFCSCPIG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPXIFXSXPIXENS

SEQ ID NO: 337641 - protein, 20 aa, Artificial Sequence
  Description of Artificial Sequence: Synthetic peptide
  Seed: SSHWLRLPRIFCSCPIGENS (PMEL_HUMAN)
  Core: IFCSCPIGE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRXFCXCXIGXNS

SEQ ID NO: 337642 - protein, 20 aa, Artificial Sequence
  Description of Artificial Sequence: Synthetic peptide
  Seed: SSHWLRLPRIFCSCPIGENS (PMEL_HUMAN)
  Core: FCSCPIGEN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRIXCSXPXGEXS

SEQ ID NO: 337643 - protein, 21 aa, Artificial Sequence
  Description of Artificial Sequence: Synthetic peptide
  Seed: SSHWLRLPRIFCSCPIGENSP (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCPIGENSP

SEQ ID NO: 337644 - protein, 21 aa, Artificial Sequence
  Description of Artificial Sequence: Synthetic peptide
  Seed: SSHWLRLPRIFCSCPIGENSP (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPXGENSP

SEQ ID NO: 337645 - protein, 21 aa, Artificial Sequence
  Description of Artificial Sequence: Synthetic peptide
  Seed: SSHWLRLPRIFCSCPIGENSP (PMEL_HUMAN)
  Core: IFCSCPIGE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRXFCXCXIGXNSP

SEQ ID NO: 337646 - protein, 21 aa, Artificial Sequence
  Description of Artificial Sequence: Synthetic peptide
  Seed: SSHWLRLPRIFCSCPIGENSP (PMEL_HUMAN)
  Core: FCSCPIGEN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRIXCSXPXGEXSP

SEQ ID NO: 337647 - protein, 22 aa, Artificial Sequence
  Description of Artificial Sequence: Synthetic peptide
  Seed: SSHWLRLPRIFCSCPIGENSPL (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCPIGENSPL

SEQ ID NO: 337648 - protein, 22 aa, Artificial Sequence
  Description of Artificial Sequence: Synthetic peptide
  Seed: SSHWLRLPRIFCSCPIGENSPL (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPXGENSPL

SEQ ID NO: 337649 - protein, 22 aa, Artificial Sequence
  Description of Artificial Sequence: Synthetic peptide
  Seed: SSHWLRLPRIFCSCPIGENSPL (PMEL_HUMAN)
  Core: IFCSCPIGE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRXFCXCXIGXNSPL

SEQ ID NO: 337650 - protein, 22 aa, Artificial Sequence
  Description of Artificial Sequence: Synthetic peptide
  Seed: SSHWLRLPRIFCSCPIGENSPL (PMEL_HUMAN)
  Core: FCSCPIGEN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRIXCSXPXGEXSPL

SEQ ID NO: 337651 - protein, 23 aa, Artificial Sequence
  Description of Artificial Sequence: Synthetic peptide
  Seed: SSHWLRLPRIFCSCPIGENSPLL (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCPIGENSPLL

SEQ ID NO: 337652 - protein, 23 aa, Artificial Sequence
  Description of Artificial Sequence: Synthetic peptide
  Seed: SSHWLRLPRIFCSCPIGENSPLL (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPXGENSPLL

SEQ ID NO: 337653 - protein, 23 aa, Artificial Sequence
  Description of Artificial Sequence: Synthetic peptide
  Seed: SSHWLRLPRIFCSCPIGENSPLL (PMEL_HUMAN)
  Core: IFCSCPIGE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRXFCXCXIGXNSPLL

SEQ ID NO: 337654 - protein, 23 aa, Artificial Sequence
  Description of Artificial Sequence: Synthetic peptide
  Seed: SSHWLRLPRIFCSCPIGENSPLL (PMEL_HUMAN)
  Core: FCSCPIGEN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRIXCSXPXGEXSPLL

SEQ ID NO: 337655 - protein, 24 aa, Artificial Sequence
  Description of Artificial Sequence: Synthetic peptide
  Seed: SSHWLRLPRIFCSCPIGENSPLLS (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCPIGENSPLLS

SEQ ID NO: 337656 - protein, 24 aa, Artificial Sequence
  Description of Artificial Sequence: Synthetic peptide
  Seed: SSHWLRLPRIFCSCPIGENSPLLS (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPXGENSPLLS

SEQ ID NO: 337657 - protein, 24 aa, Artificial Sequence
  Description of Artificial Sequence: Synthetic peptide
  Seed: SSHWLRLPRIFCSCPIGENSPLLS (PMEL_HUMAN)
  Core: IFCSCPIGE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRXFCXCXIGXNSPLLS

SEQ ID NO: 337658 - protein, 24 aa, Artificial Sequence
  Description of Artificial Sequence: Synthetic peptide
  Seed: SSHWLRLPRIFCSCPIGENSPLLS (PMEL_HUMAN)
  Core: FCSCPIGEN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRIXCSXPXGEXSPLLS

SEQ ID NO: 337659 - protein, 25 aa, Artificial Sequence
  Description of Artificial Sequence: Synthetic peptide
  Seed: SSHWLRLPRIFCSCPIGENSPLLSG (PMEL_HUMAN)
  Core: WLRLPRIFC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSHXLRXPXIFXSCPIGENSPLLSG

SEQ ID NO: 337660 - protein, 25 aa, Artificial Sequence
  Description of Artificial Sequence: Synthetic peptide
  Seed: SSHWLRLPRIFCSCPIGENSPLLSG (PMEL_HUMAN)
  Core: PRIFCSCPI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLXRIXCXCPXGENSPLLSG

SEQ ID NO: 337661 - protein, 25 aa, Artificial Sequence
  Description of Artificial Sequence: Synthetic peptide
  Seed: SSHWLRLPRIFCSCPIGENSPLLSG (PMEL_HUMAN)
  Core: IFCSCPIGE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRXFCXCXIGXNSPLLSG

SEQ ID NO: 337662 - protein, 25 aa, Artificial Sequence
  Description of Artificial Sequence: Synthetic peptide
  Seed: SSHWLRLPRIFCSCPIGENSPLLSG (PMEL_HUMAN)
  Core: FCSCPIGEN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSHWLRLPRIXCSXPXGEXSPLLSG

SEQ ID NO: 337663 - protein, 14 aa, Artificial Sequence
  Description of Artificial Sequence: Synthetic peptide
  Seed: SSIMSTESITGSLG (PMEL_HUMAN)
  Core: IMSTESITG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXMSXEXITXSLG

SEQ ID NO: 337664 - protein, 15 aa, Artificial Sequence
  Description of Artificial Sequence: Synthetic peptide
  Seed: SSIMSTESITGSLGP (PMEL_HUMAN)
  Core: IMSTESITG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXMSXEXITXSLGP

SEQ ID NO: 337665 - protein, 16 aa, Artificial Sequence
  Description of Artificial Sequence: Synthetic peptide
  Seed: SSIMSTESITGSLGPL (PMEL_HUMAN)
  Core: IMSTESITG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXMSXEXITXSLGPL

SEQ ID NO: 337666 - protein, 17 aa, Artificial Sequence
  Description of Artificial Sequence: Synthetic peptide
  Seed: SSIMSTESITGSLGPLL (PMEL_HUMAN)
  Core: IMSTESITG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXMSXEXITXSLGPLL

SEQ ID NO: 337667 - protein, 17 aa, Artificial Sequence
  Description of Artificial Sequence: Synthetic peptide
  Seed: SSIMSTESITGSLGPLL (PMEL_HUMAN)
  Core: MSTESITGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSIXSTXSXTGXLGPLL

SEQ ID NO: 337668 - protein, 17 aa, Artificial Sequence
  Description of Artificial Sequence: Synthetic peptide
  Seed: SSIMSTESITGSLGPLL (PMEL_HUMAN)
  Core: ITGSLGPLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTESXTGXLXPLX

SEQ ID NO: 337669 - protein, 19 aa, Artificial Sequence
  Description of Artificial Sequence: Synthetic peptide
  Seed: SSIMSTESITGSLGPLLDG (PMEL_HUMAN)
  Core: ITGSLGPLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTESXTGXLXPLXDG

SEQ ID NO: 337670 - protein, 20 aa, Artificial Sequence
  Description of Artificial Sequence: Synthetic peptide
  Seed: SSIMSTESITGSLGPLLDGT (PMEL_HUMAN)
  Core: SITGSLGPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTEXITXSXGPXLDGT

SEQ ID NO: 337671 - protein, 20 aa, Artificial Sequence
  Description of Artificial Sequence: Synthetic peptide
  Seed: SSIMSTESITGSLGPLLDGT (PMEL_HUMAN)
  Core: ITGSLGPLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTESXTGXLXPLXDGT

SEQ ID NO: 337672 - protein, 21 aa, Artificial Sequence
  Description of Artificial Sequence: Synthetic peptide
  Seed: SSIMSTESITGSLGPLLDGTA (PMEL_HUMAN)
  Core: ITGSLGPLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTESXTGXLXPLXDGTA

SEQ ID NO: 337673 - protein, 22 aa, Artificial Sequence
  Description of Artificial Sequence: Synthetic peptide
  Seed: SSIMSTESITGSLGPLLDGTAT (PMEL_HUMAN)
  Core: ITGSLGPLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTESXTGXLXPLXDGTAT

SEQ ID NO: 337674 - protein, 23 aa, Artificial Sequence
  Description of Artificial Sequence: Synthetic peptide
  Seed: SSIMSTESITGSLGPLLDGTATL (PMEL_HUMAN)
  Core: ITGSLGPLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTESXTGXLXPLXDGTATL

SEQ ID NO: 337675 - protein, 24 aa, Artificial Sequence
  Description of Artificial Sequence: Synthetic peptide
  Seed: SSIMSTESITGSLGPLLDGTATLR (PMEL_HUMAN)
  Core: ITGSLGPLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTESXTGXLXPLXDGTATLR

SEQ ID NO: 337676 - protein, 25 aa, Artificial Sequence
  Description of Artificial Sequence: Synthetic peptide
  Seed: SSIMSTESITGSLGPLLDGTATLRL (PMEL_HUMAN)
  Core: ITGSLGPLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTESXTGXLXPLXDGTATLRL

SEQ ID NO: 337677 - protein, 25 aa, Artificial Sequence
  Description of Artificial Sequence: Synthetic peptide
  Seed: SSIMSTESITGSLGPLLDGTATLRL (PMEL_HUMAN)
  Core: LGPLLDGTA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SSIMSTESITGSXGPXLXGTXTLRL

SEQ ID NO: 337678 - protein, 25 aa, Artificial Sequence
  Description of Artificial Sequence: Synthetic peptide
  Seed: SSPGCQPPAQRLCQPVLPSPACQLV (PMEL_HUMAN)
  Core: QRLCQPVLP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSPGCQPPAXRLXQXVLXSPACQLV

SEQ ID NO: 337679 - protein, 14 aa, Artificial Sequence
  Description of Artificial Sequence: Synthetic peptide
  Seed: SSSAFTITDQVPFS (PMEL_HUMAN)
  Core: SAFTITDQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXAFXIXDQXPFS

SEQ ID NO: 337680 - protein, 14 aa, Artificial Sequence
  Description of Artificial Sequence: Synthetic peptide
  Seed: SSSAFTITDQVPFS (PMEL_HUMAN)
  Core: AFTITDQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSSXFTXTXQVXFS

SEQ ID NO: 337681 - protein, 14 aa, Artificial Sequence
  Description of Artificial Sequence: Synthetic peptide
  Seed: SSSAFTITDQVPFS (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXS

SEQ ID NO: 337682 - protein, 15 aa, Artificial Sequence
  Description of Artificial Sequence: Synthetic peptide
  Seed: SSSAFTITDQVPFSV (PMEL_HUMAN)
  Core: SAFTITDQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXAFXIXDQXPFSV

SEQ ID NO: 337683 - protein, 15 aa, Artificial Sequence
  Description of Artificial Sequence: Synthetic peptide
  Seed: SSSAFTITDQVPFSV (PMEL_HUMAN)
  Core: AFTITDQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSSXFTXTXQVXFSV

SEQ ID NO: 337684 - protein, 15 aa, Artificial Sequence
  Description of Artificial Sequence: Synthetic peptide
  Seed: SSSAFTITDQVPFSV (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSV

SEQ ID NO: 337685 - protein, 15 aa, Artificial Sequence
  Description of Artificial Sequence: Synthetic peptide
  Seed: SSSAFTITDQVPFSV (PMEL_HUMAN)
  Core: TITDQVPFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFXITXQXPFXV

SEQ ID NO: 337686 - protein, 16 aa, Artificial Sequence
  Description of Artificial Sequence: Synthetic peptide
  Seed: SSSAFTITDQVPFSVS (PMEL_HUMAN)
  Core: AFTITDQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSSXFTXTXQVXFSVS

SEQ ID NO: 337687 - protein, 16 aa, Artificial Sequence
  Description of Artificial Sequence: Synthetic peptide
  Seed: SSSAFTITDQVPFSVS (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVS

SEQ ID NO: 337688 - protein, 16 aa, Artificial Sequence
  Description of Artificial Sequence: Synthetic peptide
  Seed: SSSAFTITDQVPFSVS (PMEL_HUMAN)
  Core: ITDQVPFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTXTDXVXFSXS

SEQ ID NO: 337689 - protein, 17 aa, Artificial Sequence
  Description of Artificial Sequence: Synthetic peptide
  Seed: SSSAFTITDQVPFSVSV (PMEL_HUMAN)
  Core: AFTITDQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSSXFTXTXQVXFSVSV

SEQ ID NO: 337690 - protein, 17 aa, Artificial Sequence
  Description of Artificial Sequence: Synthetic peptide
  Seed: SSSAFTITDQVPFSVSV (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVSV

SEQ ID NO: 337691 - protein, 17 aa, Artificial Sequence
  Description of Artificial Sequence: Synthetic peptide
  Seed: SSSAFTITDQVPFSVSV (PMEL_HUMAN)
  Core: ITDQVPFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTXTDXVXFSXSV

SEQ ID NO: 337692 - protein, 18 aa, Artificial Sequence
  Description of Artificial Sequence: Synthetic peptide
  Seed: SSSAFTITDQVPFSVSVS (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVSVS

SEQ ID NO: 337693 - protein, 18 aa, Artificial Sequence
  Description of Artificial Sequence: Synthetic peptide
  Seed: SSSAFTITDQVPFSVSVS (PMEL_HUMAN)
  Core: ITDQVPFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTXTDXVXFSXSVS

SEQ ID NO: 337694 - protein, 19 aa, Artificial Sequence
  Description of Artificial Sequence: Synthetic peptide
  Seed: SSSAFTITDQVPFSVSVSQ (PMEL_HUMAN)
  Core: AFTITDQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSSXFTXTXQVXFSVSVSQ

SEQ ID NO: 337695 - protein, 19 aa, Artificial Sequence
  Description of Artificial Sequence: Synthetic peptide
  Seed: SSSAFTITDQVPFSVSVSQ (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVSVSQ

SEQ ID NO: 337696 - protein, 19 aa, Artificial Sequence
  Description of Artificial Sequence: Synthetic peptide
  Seed: SSSAFTITDQVPFSVSVSQ (PMEL_HUMAN)
  Core: ITDQVPFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTXTDXVXFSXSVSQ

SEQ ID NO: 337697 - protein, 19 aa, Artificial Sequence
  Description of Artificial Sequence: Synthetic peptide
  Seed: SSSAFTITDQVPFSVSVSQ (PMEL_HUMAN)
  Core: QVPFSVSVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDXVPXSXSVXQ

SEQ ID NO: 337698 - protein, 20 aa, Artificial Sequence
  Description of Artificial Sequence: Synthetic peptide
  Seed: SSSAFTITDQVPFSVSVSQL (PMEL_HUMAN)
  Core: AFTITDQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSSXFTXTXQVXFSVSVSQL

SEQ ID NO: 337699 - protein, 20 aa, Artificial Sequence
  Description of Artificial Sequence: Synthetic peptide
  Seed: SSSAFTITDQVPFSVSVSQL (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVSVSQL

SEQ ID NO: 337700 - protein, 20 aa, Artificial Sequence
  Description of Artificial Sequence: Synthetic peptide
  Seed: SSSAFTITDQVPFSVSVSQL (PMEL_HUMAN)
  Core: TITDQVPFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFXITXQXPFXVSVSQL

SEQ ID NO: 337701 - protein, 20 aa, Artificial Sequence
  Description of Artificial Sequence: Synthetic peptide
  Seed: SSSAFTITDQVPFSVSVSQL (PMEL_HUMAN)
  Core: ITDQVPFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTXTDXVXFSXSVSQL

SEQ ID NO: 337702 - protein, 20 aa, Artificial Sequence
  Description of Artificial Sequence: Synthetic peptide
  Seed: SSSAFTITDQVPFSVSVSQL (PMEL_HUMAN)
  Core: QVPFSVSVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDXVPXSXSVXQL

SEQ ID NO: 337703 - protein, 21 aa, Artificial Sequence
  Description of Artificial Sequence: Synthetic peptide
  Seed: SSSAFTITDQVPFSVSVSQLR (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVSVSQLR

SEQ ID NO: 337704 - protein, 21 aa, Artificial Sequence
  Description of Artificial Sequence: Synthetic peptide
  Seed: SSSAFTITDQVPFSVSVSQLR (PMEL_HUMAN)
  Core: ITDQVPFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTXTDXVXFSXSVSQLR

SEQ ID NO: 337705 - protein, 21 aa, Artificial Sequence
  Description of Artificial Sequence: Synthetic peptide
  Seed: SSSAFTITDQVPFSVSVSQLR (PMEL_HUMAN)
  Core: QVPFSVSVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDXVPXSXSVXQLR

SEQ ID NO: 337706 - protein, 21 aa, Artificial Sequence
  Description of Artificial Sequence: Synthetic peptide
  Seed: SSSAFTITDQVPFSVSVSQLR (PMEL_HUMAN)
  Core: PFSVSVSQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVXFSXSXSQXR

SEQ ID NO: 337707 - protein, 22 aa, Artificial Sequence
  Description of Artificial Sequence: Synthetic peptide
  Seed: SSSAFTITDQVPFSVSVSQLRA (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVSVSQLRA

SEQ ID NO: 337708 - protein, 22 aa, Artificial Sequence
  Description of Artificial Sequence: Synthetic peptide
  Seed: SSSAFTITDQVPFSVSVSQLRA (PMEL_HUMAN)
  Core: ITDQVPFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTXTDXVXFSXSVSQLRA

SEQ ID NO: 337709 - protein, 22 aa, Artificial Sequence
  Description of Artificial Sequence: Synthetic peptide
  Seed: SSSAFTITDQVPFSVSVSQLRA (PMEL_HUMAN)
  Core: QVPFSVSVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDXVPXSXSVXQLRA

SEQ ID NO: 337710 - protein, 22 aa, Artificial Sequence
  Description of Artificial Sequence: Synthetic peptide
  Seed: SSSAFTITDQVPFSVSVSQLRA (PMEL_HUMAN)
  Core: PFSVSVSQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVXFSXSXSQXRA

SEQ ID NO: 337711 - protein, 22 aa, Artificial Sequence
  Description of Artificial Sequence: Synthetic peptide
  Seed: SSSAFTITDQVPFSVSVSQLRA (PMEL_HUMAN)
  Core: FSVSVSQLR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVPXSVXVXQLXA

SEQ ID NO: 337712 - protein, 23 aa, Artificial Sequence
  Description of Artificial Sequence: Synthetic peptide
  Seed: SSSAFTITDQVPFSVSVSQLRAL (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVSVSQLRAL

SEQ ID NO: 337713 - protein, 23 aa, Artificial Sequence
  Description of Artificial Sequence: Synthetic peptide
  Seed: SSSAFTITDQVPFSVSVSQLRAL (PMEL_HUMAN)
  Core: ITDQVPFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTXTDXVXFSXSVSQLRAL

SEQ ID NO: 337714 - protein, 23 aa, Artificial Sequence
  Description of Artificial Sequence: Synthetic peptide
  Seed: SSSAFTITDQVPFSVSVSQLRAL (PMEL_HUMAN)
  Core: QVPFSVSVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDXVPXSXSVXQLRAL

SEQ ID NO: 337715 - protein, 23 aa, Artificial Sequence
  Description of Artificial Sequence: Synthetic peptide
  Seed: SSSAFTITDQVPFSVSVSQLRAL (PMEL_HUMAN)
  Core: PFSVSVSQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVXFSXSXSQXRAL

SEQ ID NO: 337716 - protein, 23 aa, Artificial Sequence
  Description of Artificial Sequence: Synthetic peptide
  Seed: SSSAFTITDQVPFSVSVSQLRAL (PMEL_HUMAN)
  Core: FSVSVSQLR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVPXSVXVXQLXAL

SEQ ID NO: 337717 - protein, 24 aa, Artificial Sequence
  Description of Artificial Sequence: Synthetic peptide
  Seed: SSSAFTITDQVPFSVSVSQLRALD (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVSVSQLRALD

SEQ ID NO: 337718 - protein, 24 aa, Artificial Sequence
  Description of Artificial Sequence: Synthetic peptide
  Seed: SSSAFTITDQVPFSVSVSQLRALD (PMEL_HUMAN)
  Core: QVPFSVSVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDXVPXSXSVXQLRALD

SEQ ID NO: 337719 - protein, 24 aa, Artificial Sequence
  Description of Artificial Sequence: Synthetic peptide
  Seed: SSSAFTITDQVPFSVSVSQLRALD (PMEL_HUMAN)
  Core: PFSVSVSQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVXFSXSXSQXRALD

SEQ ID NO: 337720 - protein, 24 aa, Artificial Sequence
  Description of Artificial Sequence: Synthetic peptide
  Seed: SSSAFTITDQVPFSVSVSQLRALD (PMEL_HUMAN)
  Core: FSVSVSQLR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVPXSVXVXQLXALD

SEQ ID NO: 337721 - protein, 24 aa, Artificial Sequence
  Description of Artificial Sequence: Synthetic peptide
  Seed: SSSAFTITDQVPFSVSVSQLRALD (PMEL_HUMAN)
  Core: VSVSQLRAL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVPFSXSVXQXRAXD

SEQ ID NO: 337722 - protein, 25 aa, Artificial Sequence
  Description of Artificial Sequence: Synthetic peptide
  Seed: SSSAFTITDQVPFSVSVSQLRALDG (PMEL_HUMAN)
  Core: FTITDQVPF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSAXTIXDXVPXSVSVSQLRALDG

SEQ ID NO: 337723 - protein, 25 aa, Artificial Sequence
  Description of Artificial Sequence: Synthetic peptide
  Seed: SSSAFTITDQVPFSVSVSQLRALDG (PMEL_HUMAN)
  Core: ITDQVPFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTXTDXVXFSXSVSQLRALDG

SEQ ID NO: 337724 - protein, 25 aa, Artificial Sequence
  Description of Artificial Sequence: Synthetic peptide
  Seed: SSSAFTITDQVPFSVSVSQLRALDG (PMEL_HUMAN)
  Core: QVPFSVSVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDXVPXSXSVXQLRALDG

SEQ ID NO: 337725 - protein, 25 aa, Artificial Sequence
  Description of Artificial Sequence: Synthetic peptide
  Seed: SSSAFTITDQVPFSVSVSQLRALDG (PMEL_HUMAN)
  Core: PFSVSVSQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVXFSXSXSQXRALDG

SEQ ID NO: 337726 - protein, 25 aa, Artificial Sequence
  Description of Artificial Sequence: Synthetic peptide
  Seed: SSSAFTITDQVPFSVSVSQLRALDG (PMEL_HUMAN)
  Core: FSVSVSQLR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVPXSVXVXQLXALDG

SEQ ID NO: 337727 - protein, 25 aa, Artificial Sequence
  Description of Artificial Sequence: Synthetic peptide
  Seed: SSSAFTITDQVPFSVSVSQLRALDG (PMEL_HUMAN)
  Core: VSVSQLRAL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SSSAFTITDQVPFSXSVXQXRAXDG

SEQ ID NO: 337728 - protein, 14 aa, Artificial Sequence
  Description of Artificial Sequence: Synthetic peptide
  Seed: SSSHWLRLPRIFCS (PMEL_HUMAN)
  Core: SHWLRLPRI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXHWXRXPRXFCS

SEQ ID NO: 337729 - protein, 14 aa, Artificial Sequence
  Description of Artificial Sequence: Synthetic peptide
  Seed: SSSHWLRLPRIFCS (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXS

SEQ ID NO: 337730 - protein, 15 aa, Artificial Sequence
  Description of Artificial Sequence: Synthetic peptide
  Seed: SSSHWLRLPRIFCSC (PMEL_HUMAN)
  Core: SHWLRLPRI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXHWXRXPRXFCSC

SEQ ID NO: 337731 - protein, 15 aa, Artificial Sequence
  Description of Artificial Sequence: Synthetic peptide
  Seed: SSSHWLRLPRIFCSC (PMEL_HUMAN)
  Core: HWLRLPRIF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSSXWLXLXRIXCSC

SEQ ID NO: 337732 - protein, 15 aa, Artificial Sequence
  Description of Artificial Sequence: Synthetic peptide
  Seed: SSSHWLRLPRIFCSC (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSC

SEQ ID NO: 337733 - protein, 16 aa, Artificial Sequence
  Description of Artificial Sequence: Synthetic peptide
  Seed: SSSHWLRLPRIFCSCP (PMEL_HUMAN)
  Core: SHWLRLPRI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXHWXRXPRXFCSCP

SEQ ID NO: 337734 - protein, 16 aa, Artificial Sequence
  Description of Artificial Sequence: Synthetic peptide
  Seed: SSSHWLRLPRIFCSCP (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSCP

SEQ ID NO: 337735 - protein, 16 aa, Artificial Sequence
  Description of Artificial Sequence: Synthetic peptide
  Seed: SSSHWLRLPRIFCSCP (PMEL_HUMAN)
  Core: LRLPRIFCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWXRLXRXFCXCP

SEQ ID NO: 337736 - protein, 17 aa, Artificial Sequence
  Description of Artificial Sequence: Synthetic peptide
  Seed: SSSHWLRLPRIFCSCPI (PMEL_HUMAN)
  Core: SHWLRLPRI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXHWXRXPRXFCSCPI

SEQ ID NO: 337737 - protein, 17 aa, Artificial Sequence
  Description of Artificial Sequence: Synthetic peptide
  Seed: SSSHWLRLPRIFCSCPI (PMEL_HUMAN)
  Core: HWLRLPRIF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSSXWLXLXRIXCSCPI

SEQ ID NO: 337738 - protein, 17 aa, Artificial Sequence
  Description of Artificial Sequence: Synthetic peptide
  Seed: SSSHWLRLPRIFCSCPI (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSCPI

SEQ ID NO: 337739 - protein, 17 aa, Artificial Sequence
  Description of Artificial Sequence: Synthetic peptide
  Seed: SSSHWLRLPRIFCSCPI (PMEL_HUMAN)
  Core: LRLPRIFCS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWXRLXRXFCXCPI

SEQ ID NO: 337740 - protein, 17 aa, Artificial Sequence
  Description of Artificial Sequence: Synthetic peptide
  Seed: SSSHWLRLPRIFCSCPI (PMEL_HUMAN)
  Core: PRIFCSCPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLXRIXCXCPX

SEQ ID NO: 337741 - protein, 18 aa, Artificial Sequence
  Description of Artificial Sequence: Synthetic peptide
  Seed: SSSHWLRLPRIFCSCPIG (PMEL_HUMAN)
  Core: PRIFCSCPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLXRIXCXCPXG

SEQ ID NO: 337742 - protein, 19 aa, Artificial Sequence
  Description of Artificial Sequence: Synthetic peptide
  Seed: SSSHWLRLPRIFCSCPIGE (PMEL_HUMAN)
  Core: SHWLRLPRI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXHWXRXPRXFCSCPIGE

SEQ ID NO: 337743 - protein, 19 aa, Artificial Sequence
  Description of Artificial Sequence: Synthetic peptide
  Seed: SSSHWLRLPRIFCSCPIGE (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSCPIGE

SEQ ID NO: 337744 - protein, 19 aa, Artificial Sequence
  Description of Artificial Sequence: Synthetic peptide
  Seed: SSSHWLRLPRIFCSCPIGE (PMEL_HUMAN)
  Core: RLPRIFCSC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLXLPXIXCSXPIGE

SEQ ID NO: 337745 - protein, 19 aa, Artificial Sequence
  Description of Artificial Sequence: Synthetic peptide
  Seed: SSSHWLRLPRIFCSCPIGE (PMEL_HUMAN)
  Core: PRIFCSCPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLXRIXCXCPXGE

SEQ ID NO: 337746 - protein, 19 aa, Artificial Sequence
  Description of Artificial Sequence: Synthetic peptide
  Seed: SSSHWLRLPRIFCSCPIGE (PMEL_HUMAN)
  Core: RIFCSCPIG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPXIFXSXPIXE

SEQ ID NO: 337747 - protein, 20 aa, Artificial Sequence
  Description of Artificial Sequence: Synthetic peptide
  Seed: SSSHWLRLPRIFCSCPIGEN (PMEL_HUMAN)
  Core: SHWLRLPRI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SSXHWXRXPRXFCSCPIGEN

SEQ ID NO: 337748 - protein, 20 aa, Artificial Sequence
  Description of Artificial Sequence: Synthetic peptide
  Seed: SSSHWLRLPRIFCSCPIGEN (PMEL_HUMAN)
  Core: HWLRLPRIF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SSSXWLXLXRIXCSCPIGEN

SEQ ID NO: 337749 - protein, 20 aa, Artificial Sequence
  Description of Artificial Sequence: Synthetic peptide
  Seed: SSSHWLRLPRIFCSCPIGEN (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSCPIGEN

SEQ ID NO: 337750 - protein, 20 aa, Artificial Sequence
  Description of Artificial Sequence: Synthetic peptide
  Seed: SSSHWLRLPRIFCSCPIGEN (PMEL_HUMAN)
  Core: RLPRIFCSC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLXLPXIXCSXPIGEN

SEQ ID NO: 337751 - protein, 20 aa, Artificial Sequence
  Description of Artificial Sequence: Synthetic peptide
  Seed: SSSHWLRLPRIFCSCPIGEN (PMEL_HUMAN)
  Core: PRIFCSCPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLXRIXCXCPXGEN

SEQ ID NO: 337752 - protein, 20 aa, Artificial Sequence
  Description of Artificial Sequence: Synthetic peptide
  Seed: SSSHWLRLPRIFCSCPIGEN (PMEL_HUMAN)
  Core: RIFCSCPIG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPXIFXSXPIXEN

SEQ ID NO: 337753 - protein, 20 aa, Artificial Sequence
  Description of Artificial Sequence: Synthetic peptide
  Seed: SSSHWLRLPRIFCSCPIGEN (PMEL_HUMAN)
  Core: IFCSCPIGE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRXFCXCXIGXN

SEQ ID NO: 337754 - protein, 21 aa, Artificial Sequence
  Description of Artificial Sequence: Synthetic peptide
  Seed: SSSHWLRLPRIFCSCPIGENS (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSCPIGENS

SEQ ID NO: 337755 - protein, 21 aa, Artificial Sequence
  Description of Artificial Sequence: Synthetic peptide
  Seed: SSSHWLRLPRIFCSCPIGENS (PMEL_HUMAN)
  Core: PRIFCSCPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLXRIXCXCPXGENS

SEQ ID NO: 337756 - protein, 21 aa, Artificial Sequence
  Description of Artificial Sequence: Synthetic peptide
  Seed: SSSHWLRLPRIFCSCPIGENS (PMEL_HUMAN)
  Core: RIFCSCPIG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPXIFXSXPIXENS

SEQ ID NO: 337757 - protein, 21 aa, Artificial Sequence
  Description of Artificial Sequence: Synthetic peptide
  Seed: SSSHWLRLPRIFCSCPIGENS (PMEL_HUMAN)
  Core: IFCSCPIGE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRXFCXCXIGXNS

SEQ ID NO: 337758 - protein, 21 aa, Artificial Sequence
  Description of Artificial Sequence: Synthetic peptide
  Seed: SSSHWLRLPRIFCSCPIGENS (PMEL_HUMAN)
  Core: FCSCPIGEN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRIXCSXPXGEXS

SEQ ID NO: 337759 - protein, 22 aa, Artificial Sequence
  Description of Artificial Sequence: Synthetic peptide
  Seed: SSSHWLRLPRIFCSCPIGENSP (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSCPIGENSP

SEQ ID NO: 337760 - protein, 22 aa, Artificial Sequence
  Description of Artificial Sequence: Synthetic peptide
  Seed: SSSHWLRLPRIFCSCPIGENSP (PMEL_HUMAN)
  Core: PRIFCSCPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLXRIXCXCPXGENSP

SEQ ID NO: 337761 - protein, 22 aa, Artificial Sequence
  Description of Artificial Sequence: Synthetic peptide
  Seed: SSSHWLRLPRIFCSCPIGENSP (PMEL_HUMAN)
  Core: IFCSCPIGE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRXFCXCXIGXNSP

SEQ ID NO: 337762 - protein, 22 aa, Artificial Sequence
  Description of Artificial Sequence: Synthetic peptide
  Seed: SSSHWLRLPRIFCSCPIGENSP (PMEL_HUMAN)
  Core: FCSCPIGEN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRIXCSXPXGEXSP

SEQ ID NO: 337763 - protein, 23 aa, Artificial Sequence
  Description of Artificial Sequence: Synthetic peptide
  Seed: SSSHWLRLPRIFCSCPIGENSPL (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSCPIGENSPL

SEQ ID NO: 337764 - protein, 23 aa, Artificial Sequence
  Description of Artificial Sequence: Synthetic peptide
  Seed: SSSHWLRLPRIFCSCPIGENSPL (PMEL_HUMAN)
  Core: PRIFCSCPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLXRIXCXCPXGENSPL

SEQ ID NO: 337765 - protein, 23 aa, Artificial Sequence
  Description of Artificial Sequence: Synthetic peptide
  Seed: SSSHWLRLPRIFCSCPIGENSPL (PMEL_HUMAN)
  Core: RIFCSCPIG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPXIFXSXPIXENSPL

SEQ ID NO: 337766 - protein, 23 aa, Artificial Sequence
  Description of Artificial Sequence: Synthetic peptide
  Seed: SSSHWLRLPRIFCSCPIGENSPL (PMEL_HUMAN)
  Core: IFCSCPIGE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRXFCXCXIGXNSPL

SEQ ID NO: 337767 - protein, 23 aa, Artificial Sequence
  Description of Artificial Sequence: Synthetic peptide
  Seed: SSSHWLRLPRIFCSCPIGENSPL (PMEL_HUMAN)
  Core: FCSCPIGEN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRIXCSXPXGEXSPL

SEQ ID NO: 337768 - protein, 24 aa, Artificial Sequence
  Description of Artificial Sequence: Synthetic peptide
  Seed: SSSHWLRLPRIFCSCPIGENSPLL (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSCPIGENSPLL

SEQ ID NO: 337769 - protein, 24 aa, Artificial Sequence
  Description of Artificial Sequence: Synthetic peptide
  Seed: SSSHWLRLPRIFCSCPIGENSPLL (PMEL_HUMAN)
  Core: PRIFCSCPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLXRIXCXCPXGENSPLL

SEQ ID NO: 337770 - protein, 24 aa, Artificial Sequence
  Description of Artificial Sequence: Synthetic peptide
  Seed: SSSHWLRLPRIFCSCPIGENSPLL (PMEL_HUMAN)
  Core: RIFCSCPIG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPXIFXSXPIXENSPLL

SEQ ID NO: 337771 - protein, 24 aa, Artificial Sequence
  Description of Artificial Sequence: Synthetic peptide
  Seed: SSSHWLRLPRIFCSCPIGENSPLL (PMEL_HUMAN)
  Core: IFCSCPIGE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRXFCXCXIGXNSPLL

SEQ ID NO: 337772 - protein, 24 aa, Artificial Sequence
  Description of Artificial Sequence: Synthetic peptide
  Seed: SSSHWLRLPRIFCSCPIGENSPLL (PMEL_HUMAN)
  Core: FCSCPIGEN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRIXCSXPXGEXSPLL

SEQ ID NO: 337773 - protein, 25 aa, Artificial Sequence
  Description of Artificial Sequence: Synthetic peptide
  Seed: SSSHWLRLPRIFCSCPIGENSPLLS (PMEL_HUMAN)
  Core: WLRLPRIFC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SSSHXLRXPXIFXSCPIGENSPLLS

SEQ ID NO: 337774 - protein, 25 aa, Artificial Sequence
  Description of Artificial Sequence: Synthetic peptide
  Seed: SSSHWLRLPRIFCSCPIGENSPLLS (PMEL_HUMAN)
  Core: PRIFCSCPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLXRIXCXCPXGENSPLLS

SEQ ID NO: 337775 - protein, 25 aa, Artificial Sequence
  Description of Artificial Sequence: Synthetic peptide
  Seed: SSSHWLRLPRIFCSCPIGENSPLLS (PMEL_HUMAN)
  Core: RIFCSCPIG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPXIFXSXPIXENSPLLS

SEQ ID NO: 337776 - protein, 25 aa, Artificial Sequence
  Description of Artificial Sequence: Synthetic peptide
  Seed: SSSHWLRLPRIFCSCPIGENSPLLS (PMEL_HUMAN)
  Core: IFCSCPIGE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRXFCXCXIGXNSPLLS

SEQ ID NO: 337777 - protein, 25 aa, Artificial Sequence
  Description of Artificial Sequence: Synthetic peptide
  Seed: SSSHWLRLPRIFCSCPIGENSPLLS (PMEL_HUMAN)
  Core: FCSCPIGEN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SSSHWLRLPRIXCSXPXGEXSPLLS

SEQ ID NO: 337778 - protein, 15 aa, Artificial Sequence
  Description of Artificial Sequence: Synthetic peptide
  Seed: STAPVQMPTAESTGM (PMEL_HUMAN)
  Core: VQMPTAEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STAPXQMXTXESXGM

SEQ ID NO: 337779 - protein, 16 aa, Artificial Sequence
  Description of Artificial Sequence: Synthetic peptide
  Seed: STAPVQMPTAESTGMT (PMEL_HUMAN)
  Core: VQMPTAEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STAPXQMXTXESXGMT

SEQ ID NO: 337780 - protein, 20 aa, Artificial Sequence
  Description of Artificial Sequence: Synthetic peptide
  Seed: STAPVQMPTAESTGMTPEKV (PMEL_HUMAN)
  Core: VQMPTAEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STAPXQMXTXESXGMTPEKV

SEQ ID NO: 337781 - protein, 14 aa, Artificial Sequence
  Description of Artificial Sequence: Synthetic peptide
  Seed: STESITGSLGPLLD (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXD

SEQ ID NO: 337782 - protein, 15 aa, Artificial Sequence
  Description of Artificial Sequence: Synthetic peptide
  Seed: STESITGSLGPLLDG (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDG

SEQ ID NO: 337783 - protein, 16 aa, Artificial Sequence
  Description of Artificial Sequence: Synthetic peptide
  Seed: STESITGSLGPLLDGT (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDGT

SEQ ID NO: 337784 - protein, 17 aa, Artificial Sequence
  Description of Artificial Sequence: Synthetic peptide
  Seed: STESITGSLGPLLDGTA (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDGTA

SEQ ID NO: 337785 - protein, 19 aa, Artificial Sequence
  Description of Artificial Sequence: Synthetic peptide
  Seed: STESITGSLGPLLDGTATL (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDGTATL

SEQ ID NO: 337786 - protein, 20 aa, Artificial Sequence
  Description of Artificial Sequence: Synthetic peptide
  Seed: STESITGSLGPLLDGTATLR (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDGTATLR

SEQ ID NO: 337787 - protein, 20 aa, Artificial Sequence
  Description of Artificial Sequence: Synthetic peptide
  Seed: STESITGSLGPLLDGTATLR (PMEL_HUMAN)
  Core: LGPLLDGTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STESITGSXGPXLXGTXTLR

SEQ ID NO: 337788 - protein, 21 aa, Artificial Sequence
  Description of Artificial Sequence: Synthetic peptide
  Seed: STESITGSLGPLLDGTATLRL (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDGTATLRL

SEQ ID NO: 337789 - protein, 22 aa, Artificial Sequence
  Description of Artificial Sequence: Synthetic peptide
  Seed: STESITGSLGPLLDGTATLRLV (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDGTATLRLV

SEQ ID NO: 337790 - protein, 22 aa, Artificial Sequence
  Description of Artificial Sequence: Synthetic peptide
  Seed: STESITGSLGPLLDGTATLRLV (PMEL_HUMAN)
  Core: LGPLLDGTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STESITGSXGPXLXGTXTLRLV

SEQ ID NO: 337791 - protein, 22 aa, Artificial Sequence
  Description of Artificial Sequence: Synthetic peptide
  Seed: STESITGSLGPLLDGTATLRLV (PMEL_HUMAN)
  Core: LDGTATLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
STESITGSLGPLXDGXAXLRXV

SEQ ID NO: 337792 - protein, 23 aa, Artificial Sequence
  Description of Artificial Sequence: Synthetic peptide
  Seed: STESITGSLGPLLDGTATLRLVK (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDGTATLRLVK

SEQ ID NO: 337793 - protein, 23 aa, Artificial Sequence
  Description of Artificial Sequence: Synthetic peptide
  Seed: STESITGSLGPLLDGTATLRLVK (PMEL_HUMAN)
  Core: LGPLLDGTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STESITGSXGPXLXGTXTLRLVK

SEQ ID NO: 337794 - protein, 23 aa, Artificial Sequence
  Description of Artificial Sequence: Synthetic peptide
  Seed: STESITGSLGPLLDGTATLRLVK (PMEL_HUMAN)
  Core: LDGTATLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
STESITGSLGPLXDGXAXLRXVK

SEQ ID NO: 337795 - protein, 24 aa, Artificial Sequence
  Description of Artificial Sequence: Synthetic peptide
  Seed: STESITGSLGPLLDGTATLRLVKR (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDGTATLRLVKR

SEQ ID NO: 337796 - protein, 24 aa, Artificial Sequence
  Description of Artificial Sequence: Synthetic peptide
  Seed: STESITGSLGPLLDGTATLRLVKR (PMEL_HUMAN)
  Core: LDGTATLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
STESITGSLGPLXDGXAXLRXVKR

SEQ ID NO: 337797 - protein, 25 aa, Artificial Sequence
  Description of Artificial Sequence: Synthetic peptide
  Seed: STESITGSLGPLLDGTATLRLVKRQ (PMEL_HUMAN)
  Core: ITGSLGPLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STESXTGXLXPLXDGTATLRLVKRQ

SEQ ID NO: 337798 - protein, 25 aa, Artificial Sequence
  Description of Artificial Sequence: Synthetic peptide
  Seed: STESITGSLGPLLDGTATLRLVKRQ (PMEL_HUMAN)
  Core: LGPLLDGTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STESITGSXGPXLXGTXTLRLVKRQ

SEQ ID NO: 337799 - protein, 25 aa, Artificial Sequence
  Description of Artificial Sequence: Synthetic peptide
  Seed: STESITGSLGPLLDGTATLRLVKRQ (PMEL_HUMAN)
  Core: LDGTATLRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
STESITGSLGPLXDGXAXLRXVKRQ

SEQ ID NO: 337800 - protein, 25 aa, Artificial Sequence
  Description of Artificial Sequence: Synthetic peptide
  Seed: STESITGSLGPLLDGTATLRLVKRQ (PMEL_HUMAN)
  Core: DGTATLRLV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
STESITGSLGPLLXGTXTXRLXKRQ

SEQ ID NO: 337801 - protein, 20 aa, Artificial Sequence
  Description of Artificial Sequence: Synthetic peptide
  Seed: STGMTPEKVPVSEVMGTTLA (PMEL_HUMAN)
  Core: VPVSEVMGT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKXPVXEXMGXTLA

SEQ ID NO: 337802 - protein, 22 aa, Artificial Sequence
  Description of Artificial Sequence: Synthetic peptide
  Seed: STGMTPEKVPVSEVMGTTLAEM (PMEL_HUMAN)
  Core: VPVSEVMGT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKXPVXEXMGXTLAEM

SEQ ID NO: 337803 - protein, 22 aa, Artificial Sequence
  Description of Artificial Sequence: Synthetic peptide
  Seed: STGMTPEKVPVSEVMGTTLAEM (PMEL_HUMAN)
  Core: VSEVMGTTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKVPXSEXMXTTXAEM

SEQ ID NO: 337804 - protein, 22 aa, Artificial Sequence
  Description of Artificial Sequence: Synthetic peptide
  Seed: STGMTPEKVPVSEVMGTTLAEM (PMEL_HUMAN)
  Core: VMGTTLAEM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKVPVSEXMGXTXAEX

SEQ ID NO: 337805 - protein, 23 aa, Artificial Sequence
  Description of Artificial Sequence: Synthetic peptide
  Seed: STGMTPEKVPVSEVMGTTLAEMS (PMEL_HUMAN)
  Core: MTPEKVPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
STGXTPXKXPVXEVMGTTLAEMS

SEQ ID NO: 337806 - protein, 23 aa, Artificial Sequence
  Description of Artificial Sequence: Synthetic peptide
  Seed: STGMTPEKVPVSEVMGTTLAEMS (PMEL_HUMAN)
  Core: VSEVMGTTL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKVPXSEXMXTTXAEMS

SEQ ID NO: 337807 - protein, 23 aa, Artificial Sequence
  Description of Artificial Sequence: Synthetic peptide
  Seed: STGMTPEKVPVSEVMGTTLAEMS (PMEL_HUMAN)
  Core: VMGTTLAEM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKVPVSEXMGXTXAEXS

SEQ ID NO: 337808 - protein, 24 aa, Artificial Sequence
  Description of Artificial Sequence: Synthetic peptide
  Seed: STGMTPEKVPVSEVMGTTLAEMST (PMEL_HUMAN)
  Core: VMGTTLAEM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKVPVSEXMGXTXAEXST

SEQ ID NO: 337809 - protein, 24 aa, Artificial Sequence
  Description of Artificial Sequence: Synthetic peptide
  Seed: STGMTPEKVPVSEVMGTTLAEMST (PMEL_HUMAN)
  Core: MGTTLAEMS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKVPVSEVXGTXLXEMXT

SEQ ID NO: 337810 - protein, 25 aa, Artificial Sequence
  Description of Artificial Sequence: Synthetic peptide
  Seed: STGMTPEKVPVSEVMGTTLAEMSTP (PMEL_HUMAN)
  Core: MTPEKVPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
STGXTPXKXPVXEVMGTTLAEMSTP

SEQ ID NO: 337811 - protein, 25 aa, Artificial Sequence
  Description of Artificial Sequence: Synthetic peptide
  Seed: STGMTPEKVPVSEVMGTTLAEMSTP (PMEL_HUMAN)
  Core: VMGTTLAEM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKVPVSEXMGXTXAEXSTP

SEQ ID NO: 337812 - protein, 25 aa, Artificial Sequence
  Description of Artificial Sequence: Synthetic peptide
  Seed: STGMTPEKVPVSEVMGTTLAEMSTP (PMEL_HUMAN)
  Core: MGTTLAEMS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
STGMTPEKVPVSEVXGTXLXEMXTP

SEQ ID NO: 337813 - protein, 14 aa, Artificial Sequence
  Description of Artificial Sequence: Synthetic peptide
  Seed: STPEATGMTPAEVS (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXS

SEQ ID NO: 337814 - protein, 15 aa, Artificial Sequence
  Description of Artificial Sequence: Synthetic peptide
  Seed: STPEATGMTPAEVSI (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSI

SEQ ID NO: 337815 - protein, 16 aa, Artificial Sequence
  Description of Artificial Sequence: Synthetic peptide
  Seed: STPEATGMTPAEVSIV (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIV

SEQ ID NO: 337816 - protein, 17 aa, Artificial Sequence
  Description of Artificial Sequence: Synthetic peptide
  Seed: STPEATGMTPAEVSIVV (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIVV

SEQ ID NO: 337817 - protein, 17 aa, Artificial Sequence
  Description of Artificial Sequence: Synthetic peptide
  Seed: STPEATGMTPAEVSIVV (PMEL_HUMAN)
  Core: MTPAEVSIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGXTPXEXSIXV

SEQ ID NO: 337818 - protein, 18 aa, Artificial Sequence
  Description of Artificial Sequence: Synthetic peptide
  Seed: STPEATGMTPAEVSIVVL (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIVVL

SEQ ID NO: 337819 - protein, 18 aa, Artificial Sequence
  Description of Artificial Sequence: Synthetic peptide
  Seed: STPEATGMTPAEVSIVVL (PMEL_HUMAN)
  Core: MTPAEVSIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGXTPXEXSIXVL

SEQ ID NO: 337820 - protein, 19 aa, Artificial Sequence
  Description of Artificial Sequence: Synthetic peptide
  Seed: STPEATGMTPAEVSIVVLS (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIVVLS

SEQ ID NO: 337821 - protein, 19 aa, Artificial Sequence
  Description of Artificial Sequence: Synthetic peptide
  Seed: STPEATGMTPAEVSIVVLS (PMEL_HUMAN)
  Core: MTPAEVSIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGXTPXEXSIXVLS

SEQ ID NO: 337822 - protein, 20 aa, Artificial Sequence
  Description of Artificial Sequence: Synthetic peptide
  Seed: STPEATGMTPAEVSIVVLSG (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIVVLSG

SEQ ID NO: 337823 - protein, 20 aa, Artificial Sequence
  Description of Artificial Sequence: Synthetic peptide
  Seed: STPEATGMTPAEVSIVVLSG (PMEL_HUMAN)
  Core: MTPAEVSIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGXTPXEXSIXVLSG

SEQ ID NO: 337824 - protein, 21 aa, Artificial Sequence
  Description of Artificial Sequence: Synthetic peptide
  Seed: STPEATGMTPAEVSIVVLSGT (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIVVLSGT

SEQ ID NO: 337825 - protein, 21 aa, Artificial Sequence
  Description of Artificial Sequence: Synthetic peptide
  Seed: STPEATGMTPAEVSIVVLSGT (PMEL_HUMAN)
  Core: MTPAEVSIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGXTPXEXSIXVLSGT

SEQ ID NO: 337826 - protein, 22 aa, Artificial Sequence
  Description of Artificial Sequence: Synthetic peptide
  Seed: STPEATGMTPAEVSIVVLSGTT (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIVVLSGTT

SEQ ID NO: 337827 - protein, 22 aa, Artificial Sequence
  Description of Artificial Sequence: Synthetic peptide
  Seed: STPEATGMTPAEVSIVVLSGTT (PMEL_HUMAN)
  Core: MTPAEVSIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGXTPXEXSIXVLSGTT

SEQ ID NO: 337828 - protein, 23 aa, Artificial Sequence
  Description of Artificial Sequence: Synthetic peptide
  Seed: STPEATGMTPAEVSIVVLSGTTA (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIVVLSGTTA

SEQ ID NO: 337829 - protein, 23 aa, Artificial Sequence
  Description of Artificial Sequence: Synthetic peptide
  Seed: STPEATGMTPAEVSIVVLSGTTA (PMEL_HUMAN)
  Core: MTPAEVSIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGXTPXEXSIXVLSGTTA

SEQ ID NO: 337830 - protein, 23 aa, Artificial Sequence
  Description of Artificial Sequence: Synthetic peptide
  Seed: STPEATGMTPAEVSIVVLSGTTA (PMEL_HUMAN)
  Core: EVSIVVLSG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGMTPAXVSXVXLSXTTA

SEQ ID NO: 337831 - protein, 24 aa, Artificial Sequence
  Description of Artificial Sequence: Synthetic peptide
  Seed: STPEATGMTPAEVSIVVLSGTTAA (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIVVLSGTTAA

SEQ ID NO: 337832 - protein, 24 aa, Artificial Sequence
  Description of Artificial Sequence: Synthetic peptide
  Seed: STPEATGMTPAEVSIVVLSGTTAA (PMEL_HUMAN)
  Core: MTPAEVSIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGXTPXEXSIXVLSGTTAA

SEQ ID NO: 337833 - protein, 24 aa, Artificial Sequence
  Description of Artificial Sequence: Synthetic peptide
  Seed: STPEATGMTPAEVSIVVLSGTTAA (PMEL_HUMAN)
  Core: EVSIVVLSG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGMTPAXVSXVXLSXTTAA

SEQ ID NO: 337834 - protein, 24 aa, Artificial Sequence
  Description of Artificial Sequence: Synthetic peptide
  Seed: STPEATGMTPAEVSIVVLSGTTAA (PMEL_HUMAN)
  Core: IVVLSGTTA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGMTPAEVSXVVXSXTTXA

SEQ ID NO: 337835 - protein, 25 aa, Artificial Sequence
  Description of Artificial Sequence: Synthetic peptide
  Seed: STPEATGMTPAEVSIVVLSGTTAAQ (PMEL_HUMAN)
  Core: ATGMTPAEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STPEXTGXTXAEXSIVVLSGTTAAQ

SEQ ID NO: 337836 - protein, 25 aa, Artificial Sequence
  Description of Artificial Sequence: Synthetic peptide
  Seed: STPEATGMTPAEVSIVVLSGTTAAQ (PMEL_HUMAN)
  Core: MTPAEVSIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGXTPXEXSIXVLSGTTAAQ

SEQ ID NO: 337837 - protein, 25 aa, Artificial Sequence
  Description of Artificial Sequence: Synthetic peptide
  Seed: STPEATGMTPAEVSIVVLSGTTAAQ (PMEL_HUMAN)
  Core: EVSIVVLSG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGMTPAXVSXVXLSXTTAAQ

SEQ ID NO: 337838 - protein, 25 aa, Artificial Sequence
  Description of Artificial Sequence: Synthetic peptide
  Seed: STPEATGMTPAEVSIVVLSGTTAAQ (PMEL_HUMAN)
  Core: IVVLSGTTA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
STPEATGMTPAEVSXVVXSXTTXAQ

SEQ ID NO: 337839 - protein, 15 aa, Artificial Sequence
  Description of Artificial Sequence: Synthetic peptide
  Seed: STQLIMPGQEAGLGQ (PMEL_HUMAN)
  Core: QLIMPGQEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
STXLIXPXQEXGLGQ

SEQ ID NO: 337840 - protein, 19 aa, Artificial Sequence
  Description of Artificial Sequence: Synthetic peptide
  Seed: STQLIMPGQEAGLGQVPLI (PMEL_HUMAN)
  Core: IMPGQEAGL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STQLXMPXQXAGXGQVPLI

SEQ ID NO: 337841 - protein, 20 aa, Artificial Sequence
  Description of Artificial Sequence: Synthetic peptide
  Seed: STQLIMPGQEAGLGQVPLIV (PMEL_HUMAN)
  Core: QLIMPGQEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
STXLIXPXQEXGLGQVPLIV

SEQ ID NO: 337842 - protein, 20 aa, Artificial Sequence
  Description of Artificial Sequence: Synthetic peptide
  Seed: STQLIMPGQEAGLGQVPLIV (PMEL_HUMAN)
  Core: IMPGQEAGL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
STQLXMPXQXAGXGQVPLIV

SEQ ID NO: 337843 - protein, 21 aa, Artificial Sequence
  Description of Artificial Sequence: Synthetic peptide
  Seed: STQLIMPGQEAGLGQVPLIVG (PMEL_HUMAN)
  Core: AGLGQVPLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEXGLXQXPLXVG

SEQ ID NO: 337844 - protein, 22 aa, Artificial Sequence
  Description of Artificial Sequence: Synthetic peptide
  Seed: STQLIMPGQEAGLGQVPLIVGI (PMEL_HUMAN)
  Core: QLIMPGQEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
STXLIXPXQEXGLGQVPLIVGI

SEQ ID NO: 337845 - protein, 22 aa, Artificial Sequence
  Description of Artificial Sequence: Synthetic peptide
  Seed: STQLIMPGQEAGLGQVPLIVGI (PMEL_HUMAN)
  Core: AGLGQVPLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEXGLXQXPLXVGI

SEQ ID NO: 337846 - protein, 22 aa, Artificial Sequence
  Description of Artificial Sequence: Synthetic peptide
  Seed: STQLIMPGQEAGLGQVPLIVGI (PMEL_HUMAN)
  Core: LGQVPLIVG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEAGXGQXPXIVXI

SEQ ID NO: 337847 - protein, 23 aa, Artificial Sequence
  Description of Artificial Sequence: Synthetic peptide
  Seed: STQLIMPGQEAGLGQVPLIVGIL (PMEL_HUMAN)
  Core: QLIMPGQEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
STXLIXPXQEXGLGQVPLIVGIL

SEQ ID NO: 337848 - protein, 23 aa, Artificial Sequence
  Description of Artificial Sequence: Synthetic peptide
  Seed: STQLIMPGQEAGLGQVPLIVGIL (PMEL_HUMAN)
  Core: AGLGQVPLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEXGLXQXPLXVGIL

SEQ ID NO: 337849 - protein, 23 aa, Artificial Sequence
  Description of Artificial Sequence: Synthetic peptide
  Seed: STQLIMPGQEAGLGQVPLIVGIL (PMEL_HUMAN)
  Core: LGQVPLIVG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEAGXGQXPXIVXIL

SEQ ID NO: 337850 - protein, 24 aa, Artificial Sequence
  Description of Artificial Sequence: Synthetic peptide
  Seed: STQLIMPGQEAGLGQVPLIVGILL (PMEL_HUMAN)
  Core: QLIMPGQEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
STXLIXPXQEXGLGQVPLIVGILL

SEQ ID NO: 337851 - protein, 24 aa, Artificial Sequence
  Description of Artificial Sequence: Synthetic peptide
  Seed: STQLIMPGQEAGLGQVPLIVGILL (PMEL_HUMAN)
  Core: AGLGQVPLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEXGLXQXPLXVGILL

SEQ ID NO: 337852 - protein, 24 aa, Artificial Sequence
  Description of Artificial Sequence: Synthetic peptide
  Seed: STQLIMPGQEAGLGQVPLIVGILL (PMEL_HUMAN)
  Core: GLGQVPLIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEAXLGXVXLIXGILL

SEQ ID NO: 337853 - protein, 24 aa, Artificial Sequence
  Description of Artificial Sequence: Synthetic peptide
  Seed: STQLIMPGQEAGLGQVPLIVGILL (PMEL_HUMAN)
  Core: LGQVPLIVG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEAGXGQXPXIVXILL

SEQ ID NO: 337854 - protein, 25 aa, Artificial Sequence
  Description of Artificial Sequence: Synthetic peptide
  Seed: STQLIMPGQEAGLGQVPLIVGILLV (PMEL_HUMAN)
  Core: QLIMPGQEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
STXLIXPXQEXGLGQVPLIVGILLV

SEQ ID NO: 337855 - protein, 25 aa, Artificial Sequence
  Description of Artificial Sequence: Synthetic peptide
  Seed: STQLIMPGQEAGLGQVPLIVGILLV (PMEL_HUMAN)
  Core: AGLGQVPLI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEXGLXQXPLXVGILLV

SEQ ID NO: 337856 - protein, 25 aa, Artificial Sequence
  Description of Artificial Sequence: Synthetic peptide
  Seed: STQLIMPGQEAGLGQVPLIVGILLV (PMEL_HUMAN)
  Core: GLGQVPLIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEAXLGXVXLIXGILLV

SEQ ID NO: 337857 - protein, 25 aa, Artificial Sequence
  Description of Artificial Sequence: Synthetic peptide
  Seed: STQLIMPGQEAGLGQVPLIVGILLV (PMEL_HUMAN)
  Core: LGQVPLIVG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
STQLIMPGQEAGXGQXPXIVXILLV

SEQ ID NO: 337858 - protein, 15 aa, Artificial Sequence
  Description of Artificial Sequence: Synthetic peptide
  Seed: SVPQLPHSSSHWLRL (PMEL_HUMAN)
  Core: LPHSSSHWL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVPQXPHXSXHWXRL

SEQ ID NO: 337859 - protein, 15 aa, Artificial Sequence
  Description of Artificial Sequence: Synthetic peptide
  Seed: SVPQLPHSSSHWLRL (PMEL_HUMAN)
  Core: PHSSSHWLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLXHSXSXWLXL

SEQ ID NO: 337860 - protein, 15 aa, Artificial Sequence
  Description of Artificial Sequence: Synthetic peptide
  Seed: SVPQLPHSSSHWLRL (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRX

SEQ ID NO: 337861 - protein, 16 aa, Artificial Sequence
  Description of Artificial Sequence: Synthetic peptide
  Seed: SVPQLPHSSSHWLRLP (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXP

SEQ ID NO: 337862 - protein, 17 aa, Artificial Sequence
  Description of Artificial Sequence: Synthetic peptide
  Seed: SVPQLPHSSSHWLRLPR (PMEL_HUMAN)
  Core: LPHSSSHWL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVPQXPHXSXHWXRLPR

SEQ ID NO: 337863 - protein, 17 aa, Artificial Sequence
  Description of Artificial Sequence: Synthetic peptide
  Seed: SVPQLPHSSSHWLRLPR (PMEL_HUMAN)
  Core: PHSSSHWLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLXHSXSXWLXLPR

SEQ ID NO: 337864 - protein, 17 aa, Artificial Sequence
  Description of Artificial Sequence: Synthetic peptide
  Seed: SVPQLPHSSSHWLRLPR (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXPR

SEQ ID NO: 337865 - protein, 18 aa, Artificial Sequence
  Description of Artificial Sequence: Synthetic peptide
  Seed: SVPQLPHSSSHWLRLPRI (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXPRI

SEQ ID NO: 337866 - protein, 19 aa, Artificial Sequence
  Description of Artificial Sequence: Synthetic peptide
  Seed: SVPQLPHSSSHWLRLPRIF (PMEL_HUMAN)
  Core: LPHSSSHWL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVPQXPHXSXHWXRLPRIF

SEQ ID NO: 337867 - protein, 19 aa, Artificial Sequence
  Description of Artificial Sequence: Synthetic peptide
  Seed: SVPQLPHSSSHWLRLPRIF (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXPRIF

SEQ ID NO: 337868 - protein, 20 aa, Artificial Sequence
  Description of Artificial Sequence: Synthetic peptide
  Seed: SVPQLPHSSSHWLRLPRIFC (PMEL_HUMAN)
  Core: LPHSSSHWL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVPQXPHXSXHWXRLPRIFC

SEQ ID NO: 337869 - protein, 20 aa, Artificial Sequence
  Description of Artificial Sequence: Synthetic peptide
  Seed: SVPQLPHSSSHWLRLPRIFC (PMEL_HUMAN)
  Core: PHSSSHWLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLXHSXSXWLXLPRIFC

SEQ ID NO: 337870 - protein, 20 aa, Artificial Sequence
  Description of Artificial Sequence: Synthetic peptide
  Seed: SVPQLPHSSSHWLRLPRIFC (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXPRIFC

SEQ ID NO: 337871 - protein, 21 aa, Artificial Sequence
  Description of Artificial Sequence: Synthetic peptide
  Seed: SVPQLPHSSSHWLRLPRIFCS (PMEL_HUMAN)
  Core: LPHSSSHWL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVPQXPHXSXHWXRLPRIFCS

SEQ ID NO: 337872 - protein, 21 aa, Artificial Sequence
  Description of Artificial Sequence: Synthetic peptide
  Seed: SVPQLPHSSSHWLRLPRIFCS (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXPRIFCS

SEQ ID NO: 337873 - protein, 21 aa, Artificial Sequence
  Description of Artificial Sequence: Synthetic peptide
  Seed: SVPQLPHSSSHWLRLPRIFCS (PMEL_HUMAN)
  Core: SSHWLRLPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSXSHXLXLPXIFCS

SEQ ID NO: 337874 - protein, 21 aa, Artificial Sequence
  Description of Artificial Sequence: Synthetic peptide
  Seed: SVPQLPHSSSHWLRLPRIFCS (PMEL_HUMAN)
  Core: SHWLRLPRI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSXHWXRXPRXFCS

SEQ ID NO: 337875 - protein, 21 aa, Artificial Sequence
  Description of Artificial Sequence: Synthetic peptide
  Seed: SVPQLPHSSSHWLRLPRIFCS (PMEL_HUMAN)
  Core: WLRLPRIFC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSSHXLRXPXIFXS

SEQ ID NO: 337876 - protein, 22 aa, Artificial Sequence
  Description of Artificial Sequence: Synthetic peptide
  Seed: SVPQLPHSSSHWLRLPRIFCSC (PMEL_HUMAN)
  Core: LPHSSSHWL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVPQXPHXSXHWXRLPRIFCSC

SEQ ID NO: 337877 - protein, 22 aa, Artificial Sequence
  Description of Artificial Sequence: Synthetic peptide
  Seed: SVPQLPHSSSHWLRLPRIFCSC (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXPRIFCSC

SEQ ID NO: 337878 - protein, 22 aa, Artificial Sequence
  Description of Artificial Sequence: Synthetic peptide
  Seed: SVPQLPHSSSHWLRLPRIFCSC (PMEL_HUMAN)
  Core: SSHWLRLPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSXSHXLXLPXIFCSC

SEQ ID NO: 337879 - protein, 22 aa, Artificial Sequence
  Description of Artificial Sequence: Synthetic peptide
  Seed: SVPQLPHSSSHWLRLPRIFCSC (PMEL_HUMAN)
  Core: SHWLRLPRI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSXHWXRXPRXFCSC

SEQ ID NO: 337880 - protein, 22 aa, Artificial Sequence
  Description of Artificial Sequence: Synthetic peptide
  Seed: SVPQLPHSSSHWLRLPRIFCSC (PMEL_HUMAN)
  Core: WLRLPRIFC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSSHXLRXPXIFXSC

SEQ ID NO: 337881 - protein, 23 aa, Artificial Sequence
  Description of Artificial Sequence: Synthetic peptide
  Seed: SVPQLPHSSSHWLRLPRIFCSCP (PMEL_HUMAN)
  Core: LPHSSSHWL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVPQXPHXSXHWXRLPRIFCSCP

SEQ ID NO: 337882 - protein, 23 aa, Artificial Sequence
  Description of Artificial Sequence: Synthetic peptide
  Seed: SVPQLPHSSSHWLRLPRIFCSCP (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXPRIFCSCP

SEQ ID NO: 337883 - protein, 23 aa, Artificial Sequence
  Description of Artificial Sequence: Synthetic peptide
  Seed: SVPQLPHSSSHWLRLPRIFCSCP (PMEL_HUMAN)
  Core: SHWLRLPRI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSXHWXRXPRXFCSCP

SEQ ID NO: 337884 - protein, 23 aa, Artificial Sequence
  Description of Artificial Sequence: Synthetic peptide
  Seed: SVPQLPHSSSHWLRLPRIFCSCP (PMEL_HUMAN)
  Core: WLRLPRIFC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSSHXLRXPXIFXSCP

SEQ ID NO: 337885 - protein, 24 aa, Artificial Sequence
  Description of Artificial Sequence: Synthetic peptide
  Seed: SVPQLPHSSSHWLRLPRIFCSCPI (PMEL_HUMAN)
  Core: LPHSSSHWL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVPQXPHXSXHWXRLPRIFCSCPI

SEQ ID NO: 337886 - protein, 24 aa, Artificial Sequence
  Description of Artificial Sequence: Synthetic peptide
  Seed: SVPQLPHSSSHWLRLPRIFCSCPI (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXPRIFCSCPI

SEQ ID NO: 337887 - protein, 24 aa, Artificial Sequence
  Description of Artificial Sequence: Synthetic peptide
  Seed: SVPQLPHSSSHWLRLPRIFCSCPI (PMEL_HUMAN)
  Core: SSSHWLRLP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHXSSXWXRLXRIFCSCPI

SEQ ID NO: 337888 - protein, 24 aa, Artificial Sequence
  Description of Artificial Sequence: Synthetic peptide
  Seed: SVPQLPHSSSHWLRLPRIFCSCPI (PMEL_HUMAN)
  Core: SHWLRLPRI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSXHWXRXPRXFCSCPI

SEQ ID NO: 337889 - protein, 24 aa, Artificial Sequence
  Description of Artificial Sequence: Synthetic peptide
  Seed: SVPQLPHSSSHWLRLPRIFCSCPI (PMEL_HUMAN)
  Core: WLRLPRIFC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSSHXLRXPXIFXSCPI

SEQ ID NO: 337890 - protein, 25 aa, Artificial Sequence
  Description of Artificial Sequence: Synthetic peptide
  Seed: SVPQLPHSSSHWLRLPRIFCSCPIG (PMEL_HUMAN)
  Core: LPHSSSHWL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVPQXPHXSXHWXRLPRIFCSCPIG

SEQ ID NO: 337891 - protein, 25 aa, Artificial Sequence
  Description of Artificial Sequence: Synthetic peptide
  Seed: SVPQLPHSSSHWLRLPRIFCSCPIG (PMEL_HUMAN)
  Core: PHSSSHWLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLXHSXSXWLXLPRIFCSCPIG

SEQ ID NO: 337892 - protein, 25 aa, Artificial Sequence
  Description of Artificial Sequence: Synthetic peptide
  Seed: SVPQLPHSSSHWLRLPRIFCSCPIG (PMEL_HUMAN)
  Core: HSSSHWLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPXSSXHXLRXPRIFCSCPIG

SEQ ID NO: 337893 - protein, 25 aa, Artificial Sequence
  Description of Artificial Sequence: Synthetic peptide
  Seed: SVPQLPHSSSHWLRLPRIFCSCPIG (PMEL_HUMAN)
  Core: SHWLRLPRI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSXHWXRXPRXFCSCPIG

SEQ ID NO: 337894 - protein, 25 aa, Artificial Sequence
  Description of Artificial Sequence: Synthetic peptide
  Seed: SVPQLPHSSSHWLRLPRIFCSCPIG (PMEL_HUMAN)
  Core: WLRLPRIFC
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSSHXLRXPXIFXSCPIG

SEQ ID NO: 337895 - protein, 25 aa, Artificial Sequence
  Description of Artificial Sequence: Synthetic peptide
  Seed: SVPQLPHSSSHWLRLPRIFCSCPIG (PMEL_HUMAN)
  Core: PRIFCSCPI
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
SVPQLPHSSSHWLRLXRIXCXCPXG

SEQ ID NO: 337896 - protein, 15 aa, Artificial Sequence
  Description of Artificial Sequence: Synthetic peptide
  Seed: SVQVPTTEVISTAPV (PMEL_HUMAN)
  Core: PTTEVISTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVQVXTTXVXSTXPV

SEQ ID NO: 337897 - protein, 16 aa, Artificial Sequence
  Description of Artificial Sequence: Synthetic peptide
  Seed: SVQVPTTEVISTAPVQ (PMEL_HUMAN)
  Core: PTTEVISTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVQVXTTXVXSTXPVQ

SEQ ID NO: 337898 - protein, 17 aa, Artificial Sequence
  Description of Artificial Sequence: Synthetic peptide
  Seed: SVQVPTTEVISTAPVQM (PMEL_HUMAN)
  Core: PTTEVISTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVQVXTTXVXSTXPVQM

SEQ ID NO: 337899 - protein, 17 aa, Artificial Sequence
  Description of Artificial Sequence: Synthetic peptide
  Seed: SVQVPTTEVISTAPVQM (PMEL_HUMAN)
  Core: VISTAPVQM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEXISXAXVQX

SEQ ID NO: 337900 - protein, 18 aa, Artificial Sequence
  Description of Artificial Sequence: Synthetic peptide
  Seed: SVQVPTTEVISTAPVQMP (PMEL_HUMAN)
  Core: PTTEVISTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVQVXTTXVXSTXPVQMP

SEQ ID NO: 337901 - protein, 19 aa, Artificial Sequence
  Description of Artificial Sequence: Synthetic peptide
  Seed: SVQVPTTEVISTAPVQMPT (PMEL_HUMAN)
  Core: TEVISTAPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTXEVXSXAPXQMPT

SEQ ID NO: 337902 - protein, 19 aa, Artificial Sequence
  Description of Artificial Sequence: Synthetic peptide
  Seed: SVQVPTTEVISTAPVQMPT (PMEL_HUMAN)
  Core: VISTAPVQM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEXISXAXVQXPT

SEQ ID NO: 337903 - protein, 20 aa, Artificial Sequence
  Description of Artificial Sequence: Synthetic peptide
  Seed: SVQVPTTEVISTAPVQMPTA (PMEL_HUMAN)
  Core: TEVISTAPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTXEVXSXAPXQMPTA

SEQ ID NO: 337904 - protein, 20 aa, Artificial Sequence
  Description of Artificial Sequence: Synthetic peptide
  Seed: SVQVPTTEVISTAPVQMPTA (PMEL_HUMAN)
  Core: EVISTAPVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTXVIXTXPVXMPTA

SEQ ID NO: 337905 - protein, 20 aa, Artificial Sequence
  Description of Artificial Sequence: Synthetic peptide
  Seed: SVQVPTTEVISTAPVQMPTA (PMEL_HUMAN)
  Core: VISTAPVQM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEXISXAXVQXPTA

SEQ ID NO: 337906 - protein, 20 aa, Artificial Sequence
  Description of Artificial Sequence: Synthetic peptide
  Seed: SVQVPTTEVISTAPVQMPTA (PMEL_HUMAN)
  Core: ISTAPVQMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEVXSTXPXQMXTA

SEQ ID NO: 337907 - protein, 21 aa, Artificial Sequence
  Description of Artificial Sequence: Synthetic peptide
  Seed: SVQVPTTEVISTAPVQMPTAE (PMEL_HUMAN)
  Core: VISTAPVQM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEXISXAXVQXPTAE

SEQ ID NO: 337908 - protein, 21 aa, Artificial Sequence
  Description of Artificial Sequence: Synthetic peptide
  Seed: SVQVPTTEVISTAPVQMPTAE (PMEL_HUMAN)
  Core: ISTAPVQMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEVXSTXPXQMXTAE

SEQ ID NO: 337909 - protein, 22 aa, Artificial Sequence
  Description of Artificial Sequence: Synthetic peptide
  Seed: SVQVPTTEVISTAPVQMPTAES (PMEL_HUMAN)
  Core: VISTAPVQM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEXISXAXVQXPTAES

SEQ ID NO: 337910 - protein, 22 aa, Artificial Sequence
  Description of Artificial Sequence: Synthetic peptide
  Seed: SVQVPTTEVISTAPVQMPTAES (PMEL_HUMAN)
  Core: ISTAPVQMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEVXSTXPXQMXTAES

SEQ ID NO: 337911 - protein, 23 aa, Artificial Sequence
  Description of Artificial Sequence: Synthetic peptide
  Seed: SVQVPTTEVISTAPVQMPTAEST (PMEL_HUMAN)
  Core: VISTAPVQM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEXISXAXVQXPTAEST

SEQ ID NO: 337912 - protein, 23 aa, Artificial Sequence
  Description of Artificial Sequence: Synthetic peptide
  Seed: SVQVPTTEVISTAPVQMPTAEST (PMEL_HUMAN)
  Core: ISTAPVQMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEVXSTXPXQMXTAEST

SEQ ID NO: 337913 - protein, 24 aa, Artificial Sequence
  Description of Artificial Sequence: Synthetic peptide
  Seed: SVQVPTTEVISTAPVQMPTAESTG (PMEL_HUMAN)
  Core: VISTAPVQM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEXISXAXVQXPTAESTG

SEQ ID NO: 337914 - protein, 24 aa, Artificial Sequence
  Description of Artificial Sequence: Synthetic peptide
  Seed: SVQVPTTEVISTAPVQMPTAESTG (PMEL_HUMAN)
  Core: ISTAPVQMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEVXSTXPXQMXTAESTG

SEQ ID NO: 337915 - protein, 25 aa, Artificial Sequence
  Description of Artificial Sequence: Synthetic peptide
  Seed: SVQVPTTEVISTAPVQMPTAESTGM (PMEL_HUMAN)
  Core: VISTAPVQM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEXISXAXVQXPTAESTGM

SEQ ID NO: 337916 - protein, 25 aa, Artificial Sequence
  Description of Artificial Sequence: Synthetic peptide
  Seed: SVQVPTTEVISTAPVQMPTAESTGM (PMEL_HUMAN)
  Core: ISTAPVQMP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVQVPTTEVXSTXPXQMXTAESTGM

SEQ ID NO: 337917 - protein, 15 aa, Artificial Sequence
  Description of Artificial Sequence: Synthetic peptide
  Seed: SVSQLRALDGGNKHF (PMEL_HUMAN)
  Core: VSQLRALDG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSQXRXLDXGNKHF

SEQ ID NO: 337918 - protein, 15 aa, Artificial Sequence
  Description of Artificial Sequence: Synthetic peptide
  Seed: SVSQLRALDGGNKHF (PMEL_HUMAN)
  Core: LRALDGGNK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVSQXRAXDXGNXHF

SEQ ID NO: 337919 - protein, 16 aa, Artificial Sequence
  Description of Artificial Sequence: Synthetic peptide
  Seed: SVSQLRALDGGNKHFL (PMEL_HUMAN)
  Core: LRALDGGNK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVSQXRAXDXGNXHFL

SEQ ID NO: 337920 - protein, 17 aa, Artificial Sequence
  Description of Artificial Sequence: Synthetic peptide
  Seed: SVSQLRALDGGNKHFLR (PMEL_HUMAN)
  Core: LRALDGGNK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVSQXRAXDXGNXHFLR

SEQ ID NO: 337921 - protein, 20 aa, Artificial Sequence
  Description of Artificial Sequence: Synthetic peptide
  Seed: SVSQLRALDGGNKHFLRNQP (PMEL_HUMAN)
  Core: LRALDGGNK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVSQXRAXDXGNXHFLRNQP

SEQ ID NO: 337922 - protein, 21 aa, Artificial Sequence
  Description of Artificial Sequence: Synthetic peptide
  Seed: SVSQLRALDGGNKHFLRNQPL (PMEL_HUMAN)
  Core: LRALDGGNK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVSQXRAXDXGNXHFLRNQPL

SEQ ID NO: 337923 - protein, 22 aa, Artificial Sequence
  Description of Artificial Sequence: Synthetic peptide
  Seed: SVSQLRALDGGNKHFLRNQPLT (PMEL_HUMAN)
  Core: LRALDGGNK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVSQXRAXDXGNXHFLRNQPLT

SEQ ID NO: 337924 - protein, 22 aa, Artificial Sequence
  Description of Artificial Sequence: Synthetic peptide
  Seed: SVSQLRALDGGNKHFLRNQPLT (PMEL_HUMAN)
  Core: LDGGNKHFL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRAXDGXNXHFXRNQPLT

SEQ ID NO: 337925 - protein, 23 aa, Artificial Sequence
  Description of Artificial Sequence: Synthetic peptide
  Seed: SVSQLRALDGGNKHFLRNQPLTF (PMEL_HUMAN)
  Core: LRALDGGNK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVSQXRAXDXGNXHFLRNQPLTF

SEQ ID NO: 337926 - protein, 23 aa, Artificial Sequence
  Description of Artificial Sequence: Synthetic peptide
  Seed: SVSQLRALDGGNKHFLRNQPLTF (PMEL_HUMAN)
  Core: RALDGGNKH
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLXALXGXNKXFLRNQPLTF

SEQ ID NO: 337927 - protein, 23 aa, Artificial Sequence
  Description of Artificial Sequence: Synthetic peptide
  Seed: SVSQLRALDGGNKHFLRNQPLTF (PMEL_HUMAN)
  Core: LDGGNKHFL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRAXDGXNXHFXRNQPLTF

SEQ ID NO: 337928 - protein, 23 aa, Artificial Sequence
  Description of Artificial Sequence: Synthetic peptide
  Seed: SVSQLRALDGGNKHFLRNQPLTF (PMEL_HUMAN)
  Core: KHFLRNQPL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRALDGGNXHFXRXQPXTF

SEQ ID NO: 337929 - protein, 23 aa, Artificial Sequence
  Description of Artificial Sequence: Synthetic peptide
  Seed: SVSQLRALDGGNKHFLRNQPLTF (PMEL_HUMAN)
  Core: FLRNQPLTF
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRALDGGNKHXLRXQXLTX

SEQ ID NO: 337930 - protein, 24 aa, Artificial Sequence
  Description of Artificial Sequence: Synthetic peptide
  Seed: SVSQLRALDGGNKHFLRNQPLTFA (PMEL_HUMAN)
  Core: LDGGNKHFL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRAXDGXNXHFXRNQPLTFA

SEQ ID NO: 337931 - protein, 24 aa, Artificial Sequence
  Description of Artificial Sequence: Synthetic peptide
  Seed: SVSQLRALDGGNKHFLRNQPLTFA (PMEL_HUMAN)
  Core: GGNKHFLRN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRALDXGNXHXLRXQPLTFA

SEQ ID NO: 337932 - protein, 24 aa, Artificial Sequence
  Description of Artificial Sequence: Synthetic peptide
  Seed: SVSQLRALDGGNKHFLRNQPLTFA (PMEL_HUMAN)
  Core: KHFLRNQPL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRALDGGNXHFXRXQPXTFA

SEQ ID NO: 337933 - protein, 24 aa, Artificial Sequence
  Description of Artificial Sequence: Synthetic peptide
  Seed: SVSQLRALDGGNKHFLRNQPLTFA (PMEL_HUMAN)
  Core: FLRNQPLTF
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRALDGGNKHXLRXQXLTXA

SEQ ID NO: 337934 - protein, 25 aa, Artificial Sequence
  Description of Artificial Sequence: Synthetic peptide
  Seed: SVSQLRALDGGNKHFLRNQPLTFAL (PMEL_HUMAN)
  Core: LRALDGGNK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SVSQXRAXDXGNXHFLRNQPLTFAL

SEQ ID NO: 337935 - protein, 25 aa, Artificial Sequence
  Description of Artificial Sequence: Synthetic peptide
  Seed: SVSQLRALDGGNKHFLRNQPLTFAL (PMEL_HUMAN)
  Core: LDGGNKHFL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRAXDGXNXHFXRNQPLTFAL

SEQ ID NO: 337936 - protein, 25 aa, Artificial Sequence
  Description of Artificial Sequence: Synthetic peptide
  Seed: SVSQLRALDGGNKHFLRNQPLTFAL (PMEL_HUMAN)
  Core: GGNKHFLRN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRALDXGNXHXLRXQPLTFAL

SEQ ID NO: 337937 - protein, 25 aa, Artificial Sequence
  Description of Artificial Sequence: Synthetic peptide
  Seed: SVSQLRALDGGNKHFLRNQPLTFAL (PMEL_HUMAN)
  Core: KHFLRNQPL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRALDGGNXHFXRXQPXTFAL

SEQ ID NO: 337938 - protein, 25 aa, Artificial Sequence
  Description of Artificial Sequence: Synthetic peptide
  Seed: SVSQLRALDGGNKHFLRNQPLTFAL (PMEL_HUMAN)
  Core: FLRNQPLTF
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SVSQLRALDGGNKHXLRXQXLTXAL

SEQ ID NO: 337939 - protein, 14 aa, Artificial Sequence
  Description of Artificial Sequence: Synthetic peptide
  Seed: SVSVSQLRALDGGN (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGN

SEQ ID NO: 337940 - protein, 15 aa, Artificial Sequence
  Description of Artificial Sequence: Synthetic peptide
  Seed: SVSVSQLRALDGGNK (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNK

SEQ ID NO: 337941 - protein, 16 aa, Artificial Sequence
  Description of Artificial Sequence: Synthetic peptide
  Seed: SVSVSQLRALDGGNKH (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNKH

SEQ ID NO: 337942 - protein, 17 aa, Artificial Sequence
  Description of Artificial Sequence: Synthetic peptide
  Seed: SVSVSQLRALDGGNKHF (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNKHF

SEQ ID NO: 337943 - protein, 19 aa, Artificial Sequence
  Description of Artificial Sequence: Synthetic peptide
  Seed: SVSVSQLRALDGGNKHFLR (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNKHFLR

SEQ ID NO: 337944 - protein, 20 aa, Artificial Sequence
  Description of Artificial Sequence: Synthetic peptide
  Seed: SVSVSQLRALDGGNKHFLRN (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNKHFLRN

SEQ ID NO: 337945 - protein, 20 aa, Artificial Sequence
  Description of Artificial Sequence: Synthetic peptide
  Seed: SVSVSQLRALDGGNKHFLRN (PMEL_HUMAN)
  Core: LRALDGGNK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQXRAXDXGNXHFLRN

SEQ ID NO: 337946 - protein, 21 aa, Artificial Sequence
  Description of Artificial Sequence: Synthetic peptide
  Seed: SVSVSQLRALDGGNKHFLRNQ (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNKHFLRNQ

SEQ ID NO: 337947 - protein, 22 aa, Artificial Sequence
  Description of Artificial Sequence: Synthetic peptide
  Seed: SVSVSQLRALDGGNKHFLRNQP (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNKHFLRNQP

SEQ ID NO: 337948 - protein, 22 aa, Artificial Sequence
  Description of Artificial Sequence: Synthetic peptide
  Seed: SVSVSQLRALDGGNKHFLRNQP (PMEL_HUMAN)
  Core: LDGGNKHFL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQLRAXDGXNXHFXRNQP

SEQ ID NO: 337949 - protein, 23 aa, Artificial Sequence
  Description of Artificial Sequence: Synthetic peptide
  Seed: SVSVSQLRALDGGNKHFLRNQPL (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNKHFLRNQPL

SEQ ID NO: 337950 - protein, 23 aa, Artificial Sequence
  Description of Artificial Sequence: Synthetic peptide
  Seed: SVSVSQLRALDGGNKHFLRNQPL (PMEL_HUMAN)
  Core: LDGGNKHFL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQLRAXDGXNXHFXRNQPL

SEQ ID NO: 337951 - protein, 24 aa, Artificial Sequence
  Description of Artificial Sequence: Synthetic peptide
  Seed: SVSVSQLRALDGGNKHFLRNQPLT (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNKHFLRNQPLT

SEQ ID NO: 337952 - protein, 24 aa, Artificial Sequence
  Description of Artificial Sequence: Synthetic peptide
  Seed: SVSVSQLRALDGGNKHFLRNQPLT (PMEL_HUMAN)
  Core: LDGGNKHFL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQLRAXDGXNXHFXRNQPLT

SEQ ID NO: 337953 - protein, 25 aa, Artificial Sequence
  Description of Artificial Sequence: Synthetic peptide
  Seed: SVSVSQLRALDGGNKHFLRNQPLTF (PMEL_HUMAN)
  Core: VSQLRALDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVSXSQXRXLDXGNKHFLRNQPLTF

SEQ ID NO: 337954 - protein, 25 aa, Artificial Sequence
  Description of Artificial Sequence: Synthetic peptide
  Seed: SVSVSQLRALDGGNKHFLRNQPLTF (PMEL_HUMAN)
  Core: LRALDGGNK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQXRAXDXGNXHFLRNQPLTF

SEQ ID NO: 337955 - protein, 25 aa, Artificial Sequence
  Description of Artificial Sequence: Synthetic peptide
  Seed: SVSVSQLRALDGGNKHFLRNQPLTF (PMEL_HUMAN)
  Core: RALDGGNKH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQLXALXGXNKXFLRNQPLTF

SEQ ID NO: 337956 - protein, 25 aa, Artificial Sequence
  Description of Artificial Sequence: Synthetic peptide
  Seed: SVSVSQLRALDGGNKHFLRNQPLTF (PMEL_HUMAN)
  Core: LDGGNKHFL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQLRAXDGXNXHFXRNQPLTF

SEQ ID NO: 337957 - protein, 25 aa, Artificial Sequence
  Description of Artificial Sequence: Synthetic peptide
  Seed: SVSVSQLRALDGGNKHFLRNQPLTF (PMEL_HUMAN)
  Core: GGNKHFLRN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQLRALDXGNXHXLRXQPLTF

SEQ ID NO: 337958 - protein, 25 aa, Artificial Sequence
  Description of Artificial Sequence: Synthetic peptide
  Seed: SVSVSQLRALDGGNKHFLRNQPLTF (PMEL_HUMAN)
  Core: KHFLRNQPL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQLRALDGGNXHFXRXQPXTF

SEQ ID NO: 337959 - protein, 25 aa, Artificial Sequence
  Description of Artificial Sequence: Synthetic peptide
  Seed: SVSVSQLRALDGGNKHFLRNQPLTF (PMEL_HUMAN)
  Core: FLRNQPLTF
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
SVSVSQLRALDGGNKHXLRXQXLTX

SEQ ID NO: 337960 - protein, 14 aa, Artificial Sequence
  Description of Artificial Sequence: Synthetic peptide
  Seed: SVTLDIVQGIESAE (PMEL_HUMAN)
  Core: LDIVQGIES
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVTXDIXQXIEXAE

SEQ ID NO: 337961 - protein, 15 aa, Artificial Sequence
  Description of Artificial Sequence: Synthetic peptide
  Seed: SVTLDIVQGIESAEI (PMEL_HUMAN)
  Core: VTLDIVQGI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXTLXIXQGXESAEI

SEQ ID NO: 337962 - protein, 15 aa, Artificial Sequence
  Description of Artificial Sequence: Synthetic peptide
  Seed: SVTLDIVQGIESAEI (PMEL_HUMAN)
  Core: LDIVQGIES
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVTXDIXQXIEXAEI

SEQ ID NO: 337963 - protein, 15 aa, Artificial Sequence
  Description of Artificial Sequence: Synthetic peptide
  Seed: SVTLDIVQGIESAEI (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEX

SEQ ID NO: 337964 - protein, 16 aa, Artificial Sequence
  Description of Artificial Sequence: Synthetic peptide
  Seed: SVTLDIVQGIESAEIL (PMEL_HUMAN)
  Core: LDIVQGIES
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVTXDIXQXIEXAEIL

SEQ ID NO: 337965 - protein, 16 aa, Artificial Sequence
  Description of Artificial Sequence: Synthetic peptide
  Seed: SVTLDIVQGIESAEIL (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXL

SEQ ID NO: 337966 - protein, 17 aa, Artificial Sequence
  Description of Artificial Sequence: Synthetic peptide
  Seed: SVTLDIVQGIESAEILQ (PMEL_HUMAN)
  Core: LDIVQGIES
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVTXDIXQXIEXAEILQ

SEQ ID NO: 337967 - protein, 17 aa, Artificial Sequence
  Description of Artificial Sequence: Synthetic peptide
  Seed: SVTLDIVQGIESAEILQ (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXLQ

SEQ ID NO: 337968 - protein, 18 aa, Artificial Sequence
  Description of Artificial Sequence: Synthetic peptide
  Seed: SVTLDIVQGIESAEILQA (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXLQA

SEQ ID NO: 337969 - protein, 18 aa, Artificial Sequence
  Description of Artificial Sequence: Synthetic peptide
  Seed: SVTLDIVQGIESAEILQA (PMEL_HUMAN)
  Core: IESAEILQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGXESXEXLQX

SEQ ID NO: 337970 - protein, 19 aa, Artificial Sequence
  Description of Artificial Sequence: Synthetic peptide
  Seed: SVTLDIVQGIESAEILQAV (PMEL_HUMAN)
  Core: LDIVQGIES
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SVTXDIXQXIEXAEILQAV

SEQ ID NO: 337971 - protein, 19 aa, Artificial Sequence
  Description of Artificial Sequence: Synthetic peptide
  Seed: SVTLDIVQGIESAEILQAV (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXLQAV

SEQ ID NO: 337972 - protein, 19 aa, Artificial Sequence
  Description of Artificial Sequence: Synthetic peptide
  Seed: SVTLDIVQGIESAEILQAV (PMEL_HUMAN)
  Core: IESAEILQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGXESXEXLQXV

SEQ ID NO: 337973 - protein, 20 aa, Artificial Sequence
  Description of Artificial Sequence: Synthetic peptide
  Seed: SVTLDIVQGIESAEILQAVP (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXLQAVP

SEQ ID NO: 337974 - protein, 20 aa, Artificial Sequence
  Description of Artificial Sequence: Synthetic peptide
  Seed: SVTLDIVQGIESAEILQAVP (PMEL_HUMAN)
  Core: IESAEILQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGXESXEXLQXVP

SEQ ID NO: 337975 - protein, 21 aa, Artificial Sequence
  Description of Artificial Sequence: Synthetic peptide
  Seed: SVTLDIVQGIESAEILQAVPS (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXLQAVPS

SEQ ID NO: 337976 - protein, 21 aa, Artificial Sequence
  Description of Artificial Sequence: Synthetic peptide
  Seed: SVTLDIVQGIESAEILQAVPS (PMEL_HUMAN)
  Core: IESAEILQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGXESXEXLQXVPS

SEQ ID NO: 337977 - protein, 22 aa, Artificial Sequence
  Description of Artificial Sequence: Synthetic peptide
  Seed: SVTLDIVQGIESAEILQAVPSG (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXLQAVPSG

SEQ ID NO: 337978 - protein, 22 aa, Artificial Sequence
  Description of Artificial Sequence: Synthetic peptide
  Seed: SVTLDIVQGIESAEILQAVPSG (PMEL_HUMAN)
  Core: IESAEILQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGXESXEXLQXVPSG

SEQ ID NO: 337979 - protein, 22 aa, Artificial Sequence
  Description of Artificial Sequence: Synthetic peptide
  Seed: SVTLDIVQGIESAEILQAVPSG (PMEL_HUMAN)
  Core: ESAEILQAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGIXSAXIXQAXPSG

SEQ ID NO: 337980 - protein, 23 aa, Artificial Sequence
  Description of Artificial Sequence: Synthetic peptide
  Seed: SVTLDIVQGIESAEILQAVPSGE (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXLQAVPSGE

SEQ ID NO: 337981 - protein, 23 aa, Artificial Sequence
  Description of Artificial Sequence: Synthetic peptide
  Seed: SVTLDIVQGIESAEILQAVPSGE (PMEL_HUMAN)
  Core: IESAEILQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGXESXEXLQXVPSGE

SEQ ID NO: 337982 - protein, 23 aa, Artificial Sequence
  Description of Artificial Sequence: Synthetic peptide
  Seed: SVTLDIVQGIESAEILQAVPSGE (PMEL_HUMAN)
  Core: ESAEILQAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGIXSAXIXQAXPSGE

SEQ ID NO: 337983 - protein, 23 aa, Artificial Sequence
  Description of Artificial Sequence: Synthetic peptide
  Seed: SVTLDIVQGIESAEILQAVPSGE (PMEL_HUMAN)
  Core: AEILQAVPS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGIESXEIXQXVPXGE

SEQ ID NO: 337984 - protein, 24 aa, Artificial Sequence
  Description of Artificial Sequence: Synthetic peptide
  Seed: SVTLDIVQGIESAEILQAVPSGEG (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXLQAVPSGEG

SEQ ID NO: 337985 - protein, 24 aa, Artificial Sequence
  Description of Artificial Sequence: Synthetic peptide
  Seed: SVTLDIVQGIESAEILQAVPSGEG (PMEL_HUMAN)
  Core: IESAEILQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGXESXEXLQXVPSGEG

SEQ ID NO: 337986 - protein, 24 aa, Artificial Sequence
  Description of Artificial Sequence: Synthetic peptide
  Seed: SVTLDIVQGIESAEILQAVPSGEG (PMEL_HUMAN)
  Core: ESAEILQAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGIXSAXIXQAXPSGEG

SEQ ID NO: 337987 - protein, 24 aa, Artificial Sequence
  Description of Artificial Sequence: Synthetic peptide
  Seed: SVTLDIVQGIESAEILQAVPSGEG (PMEL_HUMAN)
  Core: AEILQAVPS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGIESXEIXQXVPXGEG

SEQ ID NO: 337988 - protein, 25 aa, Artificial Sequence
  Description of Artificial Sequence: Synthetic peptide
  Seed: SVTLDIVQGIESAEILQAVPSGEGD (PMEL_HUMAN)
  Core: VQGIESAEI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIXQGXEXAEXLQAVPSGEGD

SEQ ID NO: 337989 - protein, 25 aa, Artificial Sequence
  Description of Artificial Sequence: Synthetic peptide
  Seed: SVTLDIVQGIESAEILQAVPSGEGD (PMEL_HUMAN)
  Core: IESAEILQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGXESXEXLQXVPSGEGD

SEQ ID NO: 337990 - protein, 25 aa, Artificial Sequence
  Description of Artificial Sequence: Synthetic peptide
  Seed: SVTLDIVQGIESAEILQAVPSGEGD (PMEL_HUMAN)
  Core: ESAEILQAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGIXSAXIXQAXPSGEGD

SEQ ID NO: 337991 - protein, 25 aa, Artificial Sequence
  Description of Artificial Sequence: Synthetic peptide
  Seed: SVTLDIVQGIESAEILQAVPSGEGD (PMEL_HUMAN)
  Core: AEILQAVPS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SVTLDIVQGIESXEIXQXVPXGEGD

SEQ ID NO: 337992 - protein, 15 aa, Artificial Sequence
  Description of Artificial Sequence: Synthetic peptide
  Seed: SWSQKRSFVYVWKTW (PMEL_HUMAN)
  Core: WSQKRSFVY
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXSQXRXFVXVWKTW

SEQ ID NO: 337993 - protein, 15 aa, Artificial Sequence
  Description of Artificial Sequence: Synthetic peptide
  Seed: SWSQKRSFVYVWKTW (PMEL_HUMAN)
  Core: KRSFVYVWK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SWSQXRSXVXVWXTW

SEQ ID NO: 337994 - protein, 15 aa, Artificial Sequence
  Description of Artificial Sequence: Synthetic peptide
  Seed: SWSQKRSFVYVWKTW (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXW

SEQ ID NO: 337995 - protein, 16 aa, Artificial Sequence
  Description of Artificial Sequence: Synthetic peptide
  Seed: SWSQKRSFVYVWKTWG (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWG

SEQ ID NO: 337996 - protein, 16 aa, Artificial Sequence
  Description of Artificial Sequence: Synthetic peptide
  Seed: SWSQKRSFVYVWKTWG (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWX

SEQ ID NO: 337997 - protein, 17 aa, Artificial Sequence
  Description of Artificial Sequence: Synthetic peptide
  Seed: SWSQKRSFVYVWKTWGQ (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWGQ

SEQ ID NO: 337998 - protein, 17 aa, Artificial Sequence
  Description of Artificial Sequence: Synthetic peptide
  Seed: SWSQKRSFVYVWKTWGQ (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWXQ

SEQ ID NO: 337999 - protein, 17 aa, Artificial Sequence
  Description of Artificial Sequence: Synthetic peptide
  Seed: SWSQKRSFVYVWKTWGQ (PMEL_HUMAN)
  Core: VYVWKTWGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFXYVXKXWGX

SEQ ID NO: 338000 - protein, 18 aa, Artificial Sequence
  Description of Artificial Sequence: Synthetic peptide
  Seed: SWSQKRSFVYVWKTWGQY (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWGQY

SEQ ID NO: 338001 - protein, 18 aa, Artificial Sequence
  Description of Artificial Sequence: Synthetic peptide
  Seed: SWSQKRSFVYVWKTWGQY (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWXQY

SEQ ID NO: 338002 - protein, 18 aa, Artificial Sequence
  Description of Artificial Sequence: Synthetic peptide
  Seed: SWSQKRSFVYVWKTWGQY (PMEL_HUMAN)
  Core: VYVWKTWGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFXYVXKXWGXY

SEQ ID NO: 338003 - protein, 18 aa, Artificial Sequence
  Description of Artificial Sequence: Synthetic peptide
  Seed: SWSQKRSFVYVWKTWGQY (PMEL_HUMAN)
  Core: YVWKTWGQY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFVXVWXTXGQX

SEQ ID NO: 338004 - protein, 19 aa, Artificial Sequence
  Description of Artificial Sequence: Synthetic peptide
  Seed: SWSQKRSFVYVWKTWGQYW (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWGQYW

SEQ ID NO: 338005 - protein, 19 aa, Artificial Sequence
  Description of Artificial Sequence: Synthetic peptide
  Seed: SWSQKRSFVYVWKTWGQYW (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWXQYW

SEQ ID NO: 338006 - protein, 19 aa, Artificial Sequence
  Description of Artificial Sequence: Synthetic peptide
  Seed: SWSQKRSFVYVWKTWGQYW (PMEL_HUMAN)
  Core: VYVWKTWGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFXYVXKXWGXYW

SEQ ID NO: 338007 - protein, 19 aa, Artificial Sequence
  Description of Artificial Sequence: Synthetic peptide
  Seed: SWSQKRSFVYVWKTWGQYW (PMEL_HUMAN)
  Core: YVWKTWGQY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFVXVWXTXGQXW

SEQ ID NO: 338008 - protein, 20 aa, Artificial Sequence
  Description of Artificial Sequence: Synthetic peptide
  Seed: SWSQKRSFVYVWKTWGQYWQ (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWGQYWQ

SEQ ID NO: 338009 - protein, 20 aa, Artificial Sequence
  Description of Artificial Sequence: Synthetic peptide
  Seed: SWSQKRSFVYVWKTWGQYWQ (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWXQYWQ

SEQ ID NO: 338010 - protein, 20 aa, Artificial Sequence
  Description of Artificial Sequence: Synthetic peptide
  Seed: SWSQKRSFVYVWKTWGQYWQ (PMEL_HUMAN)
  Core: VYVWKTWGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFXYVXKXWGXYWQ

SEQ ID NO: 338011 - protein, 20 aa, Artificial Sequence
  Description of Artificial Sequence: Synthetic peptide
  Seed: SWSQKRSFVYVWKTWGQYWQ (PMEL_HUMAN)
  Core: YVWKTWGQY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFVXVWXTXGQXWQ

SEQ ID NO: 338012 - protein, 21 aa, Artificial Sequence
  Description of Artificial Sequence: Synthetic peptide
  Seed: SWSQKRSFVYVWKTWGQYWQV (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWGQYWQV

SEQ ID NO: 338013 - protein, 21 aa, Artificial Sequence
  Description of Artificial Sequence: Synthetic peptide
  Seed: SWSQKRSFVYVWKTWGQYWQV (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWXQYWQV

SEQ ID NO: 338014 - protein, 21 aa, Artificial Sequence
  Description of Artificial Sequence: Synthetic peptide
  Seed: SWSQKRSFVYVWKTWGQYWQV (PMEL_HUMAN)
  Core: VYVWKTWGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFXYVXKXWGXYWQV

SEQ ID NO: 338015 - protein, 21 aa, Artificial Sequence
  Description of Artificial Sequence: Synthetic peptide
  Seed: SWSQKRSFVYVWKTWGQYWQV (PMEL_HUMAN)
  Core: YVWKTWGQY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFVXVWXTXGQXWQV

SEQ ID NO: 338016 - protein, 22 aa, Artificial Sequence
  Description of Artificial Sequence: Synthetic peptide
  Seed: SWSQKRSFVYVWKTWGQYWQVL (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWGQYWQVL

SEQ ID NO: 338017 - protein, 22 aa, Artificial Sequence
  Description of Artificial Sequence: Synthetic peptide
  Seed: SWSQKRSFVYVWKTWGQYWQVL (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWXQYWQVL

SEQ ID NO: 338018 - protein, 22 aa, Artificial Sequence
  Description of Artificial Sequence: Synthetic peptide
  Seed: SWSQKRSFVYVWKTWGQYWQVL (PMEL_HUMAN)
  Core: VYVWKTWGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFXYVXKXWGXYWQVL

SEQ ID NO: 338019 - protein, 22 aa, Artificial Sequence
  Description of Artificial Sequence: Synthetic peptide
  Seed: SWSQKRSFVYVWKTWGQYWQVL (PMEL_HUMAN)
  Core: YVWKTWGQY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFVXVWXTXGQXWQVL

SEQ ID NO: 338020 - protein, 23 aa, Artificial Sequence
  Description of Artificial Sequence: Synthetic peptide
  Seed: SWSQKRSFVYVWKTWGQYWQVLG (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWGQYWQVLG

SEQ ID NO: 338021 - protein, 23 aa, Artificial Sequence
  Description of Artificial Sequence: Synthetic peptide
  Seed: SWSQKRSFVYVWKTWGQYWQVLG (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWXQYWQVLG

SEQ ID NO: 338022 - protein, 23 aa, Artificial Sequence
  Description of Artificial Sequence: Synthetic peptide
  Seed: SWSQKRSFVYVWKTWGQYWQVLG (PMEL_HUMAN)
  Core: VYVWKTWGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFXYVXKXWGXYWQVLG

SEQ ID NO: 338023 - protein, 23 aa, Artificial Sequence
  Description of Artificial Sequence: Synthetic peptide
  Seed: SWSQKRSFVYVWKTWGQYWQVLG (PMEL_HUMAN)
  Core: YVWKTWGQY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFVXVWXTXGQXWQVLG

SEQ ID NO: 338024 - protein, 24 aa, Artificial Sequence
  Description of Artificial Sequence: Synthetic peptide
  Seed: SWSQKRSFVYVWKTWGQYWQVLGG (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWGQYWQVLGG

SEQ ID NO: 338025 - protein, 24 aa, Artificial Sequence
  Description of Artificial Sequence: Synthetic peptide
  Seed: SWSQKRSFVYVWKTWGQYWQVLGG (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWXQYWQVLGG

SEQ ID NO: 338026 - protein, 24 aa, Artificial Sequence
  Description of Artificial Sequence: Synthetic peptide
  Seed: SWSQKRSFVYVWKTWGQYWQVLGG (PMEL_HUMAN)
  Core: VYVWKTWGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFXYVXKXWGXYWQVLGG

SEQ ID NO: 338027 - protein, 24 aa, Artificial Sequence
  Description of Artificial Sequence: Synthetic peptide
  Seed: SWSQKRSFVYVWKTWGQYWQVLGG (PMEL_HUMAN)
  Core: YVWKTWGQY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFVXVWXTXGQXWQVLGG

SEQ ID NO: 338028 - protein, 25 aa, Artificial Sequence
  Description of Artificial Sequence: Synthetic peptide
  Seed: SWSQKRSFVYVWKTWGQYWQVLGGP (PMEL_HUMAN)
  Core: RSFVYVWKT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKXSFXYXWKXWGQYWQVLGGP

SEQ ID NO: 338029 - protein, 25 aa, Artificial Sequence
  Description of Artificial Sequence: Synthetic peptide
  Seed: SWSQKRSFVYVWKTWGQYWQVLGGP (PMEL_HUMAN)
  Core: FVYVWKTWG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSXVYXWXTWXQYWQVLGGP

SEQ ID NO: 338030 - protein, 25 aa, Artificial Sequence
  Description of Artificial Sequence: Synthetic peptide
  Seed: SWSQKRSFVYVWKTWGQYWQVLGGP (PMEL_HUMAN)
  Core: VYVWKTWGQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFXYVXKXWGXYWQVLGGP

SEQ ID NO: 338031 - protein, 25 aa, Artificial Sequence
  Description of Artificial Sequence: Synthetic peptide
  Seed: SWSQKRSFVYVWKTWGQYWQVLGGP (PMEL_HUMAN)
  Core: YVWKTWGQY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFVXVWXTXGQXWQVLGGP

SEQ ID NO: 338032 - protein, 25 aa, Artificial Sequence
  Description of Artificial Sequence: Synthetic peptide
  Seed: SWSQKRSFVYVWKTWGQYWQVLGGP (PMEL_HUMAN)
  Core: TWGQYWQVL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SWSQKRSFVYVWKXWGXYXQVXGGP

SEQ ID NO: 338033 - protein, 15 aa, Artificial Sequence
  Description of Artificial Sequence: Synthetic peptide
  Seed: SYTWDFGDSSGTLIS (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLIS

SEQ ID NO: 338034 - protein, 15 aa, Artificial Sequence
  Description of Artificial Sequence: Synthetic peptide
  Seed: SYTWDFGDSSGTLIS (PMEL_HUMAN)
  Core: FGDSSGTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDXGDXSXTLXS

SEQ ID NO: 338035 - protein, 16 aa, Artificial Sequence
  Description of Artificial Sequence: Synthetic peptide
  Seed: SYTWDFGDSSGTLISR (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISR

SEQ ID NO: 338036 - protein, 17 aa, Artificial Sequence
  Description of Artificial Sequence: Synthetic peptide
  Seed: SYTWDFGDSSGTLISRA (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISRA

SEQ ID NO: 338037 - protein, 17 aa, Artificial Sequence
  Description of Artificial Sequence: Synthetic peptide
  Seed: SYTWDFGDSSGTLISRA (PMEL_HUMAN)
  Core: SSGTLISRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDXSGXLXSRX

SEQ ID NO: 338038 - protein, 18 aa, Artificial Sequence
  Description of Artificial Sequence: Synthetic peptide
  Seed: SYTWDFGDSSGTLISRAL (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISRAL

SEQ ID NO: 338039 - protein, 18 aa, Artificial Sequence
  Description of Artificial Sequence: Synthetic peptide
  Seed: SYTWDFGDSSGTLISRAL (PMEL_HUMAN)
  Core: SSGTLISRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDXSGXLXSRXL

SEQ ID NO: 338040 - protein, 19 aa, Artificial Sequence
  Description of Artificial Sequence: Synthetic peptide
  Seed: SYTWDFGDSSGTLISRALV (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISRALV

SEQ ID NO: 338041 - protein, 19 aa, Artificial Sequence
  Description of Artificial Sequence: Synthetic peptide
  Seed: SYTWDFGDSSGTLISRALV (PMEL_HUMAN)
  Core: FGDSSGTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDXGDXSXTLXSRALV

SEQ ID NO: 338042 - protein, 19 aa, Artificial Sequence
  Description of Artificial Sequence: Synthetic peptide
  Seed: SYTWDFGDSSGTLISRALV (PMEL_HUMAN)
  Core: SSGTLISRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDXSGXLXSRXLV

SEQ ID NO: 338043 - protein, 20 aa, Artificial Sequence
  Description of Artificial Sequence: Synthetic peptide
  Seed: SYTWDFGDSSGTLISRALVV (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISRALVV

SEQ ID NO: 338044 - protein, 20 aa, Artificial Sequence
  Description of Artificial Sequence: Synthetic peptide
  Seed: SYTWDFGDSSGTLISRALVV (PMEL_HUMAN)
  Core: FGDSSGTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDXGDXSXTLXSRALVV

SEQ ID NO: 338045 - protein, 20 aa, Artificial Sequence
  Description of Artificial Sequence: Synthetic peptide
  Seed: SYTWDFGDSSGTLISRALVV (PMEL_HUMAN)
  Core: SSGTLISRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDXSGXLXSRXLVV

SEQ ID NO: 338046 - protein, 20 aa, Artificial Sequence
  Description of Artificial Sequence: Synthetic peptide
  Seed: SYTWDFGDSSGTLISRALVV (PMEL_HUMAN)
  Core: SGTLISRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSXGTXIXRAXVV

SEQ ID NO: 338047 - protein, 21 aa, Artificial Sequence
  Description of Artificial Sequence: Synthetic peptide
  Seed: SYTWDFGDSSGTLISRALVVT (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISRALVVT

SEQ ID NO: 338048 - protein, 21 aa, Artificial Sequence
  Description of Artificial Sequence: Synthetic peptide
  Seed: SYTWDFGDSSGTLISRALVVT (PMEL_HUMAN)
  Core: FGDSSGTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDXGDXSXTLXSRALVVT

SEQ ID NO: 338049 - protein, 21 aa, Artificial Sequence
  Description of Artificial Sequence: Synthetic peptide
  Seed: SYTWDFGDSSGTLISRALVVT (PMEL_HUMAN)
  Core: SSGTLISRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDXSGXLXSRXLVVT

SEQ ID NO: 338050 - protein, 21 aa, Artificial Sequence
  Description of Artificial Sequence: Synthetic peptide
  Seed: SYTWDFGDSSGTLISRALVVT (PMEL_HUMAN)
  Core: TLISRALVV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGXLIXRXLVXT

SEQ ID NO: 338051 - protein, 22 aa, Artificial Sequence
  Description of Artificial Sequence: Synthetic peptide
  Seed: SYTWDFGDSSGTLISRALVVTH (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISRALVVTH

SEQ ID NO: 338052 - protein, 22 aa, Artificial Sequence
  Description of Artificial Sequence: Synthetic peptide
  Seed: SYTWDFGDSSGTLISRALVVTH (PMEL_HUMAN)
  Core: FGDSSGTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDXGDXSXTLXSRALVVTH

SEQ ID NO: 338053 - protein, 22 aa, Artificial Sequence
  Description of Artificial Sequence: Synthetic peptide
  Seed: SYTWDFGDSSGTLISRALVVTH (PMEL_HUMAN)
  Core: SSGTLISRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDXSGXLXSRXLVVTH

SEQ ID NO: 338054 - protein, 22 aa, Artificial Sequence
  Description of Artificial Sequence: Synthetic peptide
  Seed: SYTWDFGDSSGTLISRALVVTH (PMEL_HUMAN)
  Core: SGTLISRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSXGTXIXRAXVVTH

SEQ ID NO: 338055 - protein, 22 aa, Artificial Sequence
  Description of Artificial Sequence: Synthetic peptide
  Seed: SYTWDFGDSSGTLISRALVVTH (PMEL_HUMAN)
  Core: TLISRALVV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGXLIXRXLVXTH

SEQ ID NO: 338056 - protein, 22 aa, Artificial Sequence
  Description of Artificial Sequence: Synthetic peptide
  Seed: SYTWDFGDSSGTLISRALVVTH (PMEL_HUMAN)
  Core: LISRALVVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGTXISXAXVVXH

SEQ ID NO: 338057 - protein, 23 aa, Artificial Sequence
  Description of Artificial Sequence: Synthetic peptide
  Seed: SYTWDFGDSSGTLISRALVVTHT (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISRALVVTHT

SEQ ID NO: 338058 - protein, 23 aa, Artificial Sequence
  Description of Artificial Sequence: Synthetic peptide
  Seed: SYTWDFGDSSGTLISRALVVTHT (PMEL_HUMAN)
  Core: FGDSSGTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDXGDXSXTLXSRALVVTHT

SEQ ID NO: 338059 - protein, 23 aa, Artificial Sequence
  Description of Artificial Sequence: Synthetic peptide
  Seed: SYTWDFGDSSGTLISRALVVTHT (PMEL_HUMAN)
  Core: SSGTLISRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDXSGXLXSRXLVVTHT

SEQ ID NO: 338060 - protein, 23 aa, Artificial Sequence
  Description of Artificial Sequence: Synthetic peptide
  Seed: SYTWDFGDSSGTLISRALVVTHT (PMEL_HUMAN)
  Core: SGTLISRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSXGTXIXRAXVVTHT

SEQ ID NO: 338061 - protein, 23 aa, Artificial Sequence
  Description of Artificial Sequence: Synthetic peptide
  Seed: SYTWDFGDSSGTLISRALVVTHT (PMEL_HUMAN)
  Core: GTLISRALV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSXTLXSXALXVTHT

SEQ ID NO: 338062 - protein, 23 aa, Artificial Sequence
  Description of Artificial Sequence: Synthetic peptide
  Seed: SYTWDFGDSSGTLISRALVVTHT (PMEL_HUMAN)
  Core: TLISRALVV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGXLIXRXLVXTHT

SEQ ID NO: 338063 - protein, 23 aa, Artificial Sequence
  Description of Artificial Sequence: Synthetic peptide
  Seed: SYTWDFGDSSGTLISRALVVTHT (PMEL_HUMAN)
  Core: LISRALVVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGTXISXAXVVXHT

SEQ ID NO: 338064 - protein, 24 aa, Artificial Sequence
  Description of Artificial Sequence: Synthetic peptide
  Seed: SYTWDFGDSSGTLISRALVVTHTY (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISRALVVTHTY

SEQ ID NO: 338065 - protein, 24 aa, Artificial Sequence
  Description of Artificial Sequence: Synthetic peptide
  Seed: SYTWDFGDSSGTLISRALVVTHTY (PMEL_HUMAN)
  Core: FGDSSGTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDXGDXSXTLXSRALVVTHTY

SEQ ID NO: 338066 - protein, 24 aa, Artificial Sequence
  Description of Artificial Sequence: Synthetic peptide
  Seed: SYTWDFGDSSGTLISRALVVTHTY (PMEL_HUMAN)
  Core: SSGTLISRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDXSGXLXSRXLVVTHTY

SEQ ID NO: 338067 - protein, 24 aa, Artificial Sequence
  Description of Artificial Sequence: Synthetic peptide
  Seed: SYTWDFGDSSGTLISRALVVTHTY (PMEL_HUMAN)
  Core: SGTLISRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSXGTXIXRAXVVTHTY

SEQ ID NO: 338068 - protein, 24 aa, Artificial Sequence
  Description of Artificial Sequence: Synthetic peptide
  Seed: SYTWDFGDSSGTLISRALVVTHTY (PMEL_HUMAN)
  Core: GTLISRALV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSXTLXSXALXVTHTY

SEQ ID NO: 338069 - protein, 24 aa, Artificial Sequence
  Description of Artificial Sequence: Synthetic peptide
  Seed: SYTWDFGDSSGTLISRALVVTHTY (PMEL_HUMAN)
  Core: TLISRALVV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGXLIXRXLVXTHTY

SEQ ID NO: 338070 - protein, 24 aa, Artificial Sequence
  Description of Artificial Sequence: Synthetic peptide
  Seed: SYTWDFGDSSGTLISRALVVTHTY (PMEL_HUMAN)
  Core: LISRALVVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGTXISXAXVVXHTY

SEQ ID NO: 338071 - protein, 24 aa, Artificial Sequence
  Description of Artificial Sequence: Synthetic peptide
  Seed: SYTWDFGDSSGTLISRALVVTHTY (PMEL_HUMAN)
  Core: ISRALVVTH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGTLXSRXLXVTXTY

SEQ ID NO: 338072 - protein, 24 aa, Artificial Sequence
  Description of Artificial Sequence: Synthetic peptide
  Seed: SYTWDFGDSSGTLISRALVVTHTY (PMEL_HUMAN)
  Core: SRALVVTHT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGTLIXRAXVXTHXY

SEQ ID NO: 338073 - protein, 25 aa, Artificial Sequence
  Description of Artificial Sequence: Synthetic peptide
  Seed: SYTWDFGDSSGTLISRALVVTHTYL (PMEL_HUMAN)
  Core: WDFGDSSGT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
SYTXDFXDXSGXLISRALVVTHTYL

SEQ ID NO: 338074 - protein, 25 aa, Artificial Sequence
  Description of Artificial Sequence: Synthetic peptide
  Seed: SYTWDFGDSSGTLISRALVVTHTYL (PMEL_HUMAN)
  Core: FGDSSGTLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDXGDXSXTLXSRALVVTHTYL

SEQ ID NO: 338075 - protein, 25 aa, Artificial Sequence
  Description of Artificial Sequence: Synthetic peptide
  Seed: SYTWDFGDSSGTLISRALVVTHTYL (PMEL_HUMAN)
  Core: SSGTLISRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDXSGXLXSRXLVVTHTYL

SEQ ID NO: 338076 - protein, 25 aa, Artificial Sequence
  Description of Artificial Sequence: Synthetic peptide
  Seed: SYTWDFGDSSGTLISRALVVTHTYL (PMEL_HUMAN)
  Core: SGTLISRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSXGTXIXRAXVVTHTYL

SEQ ID NO: 338077 - protein, 25 aa, Artificial Sequence
  Description of Artificial Sequence: Synthetic peptide
  Seed: SYTWDFGDSSGTLISRALVVTHTYL (PMEL_HUMAN)
  Core: GTLISRALV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSXTLXSXALXVTHTYL

SEQ ID NO: 338078 - protein, 25 aa, Artificial Sequence
  Description of Artificial Sequence: Synthetic peptide
  Seed: SYTWDFGDSSGTLISRALVVTHTYL (PMEL_HUMAN)
  Core: TLISRALVV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGXLIXRXLVXTHTYL

SEQ ID NO: 338079 - protein, 25 aa, Artificial Sequence
  Description of Artificial Sequence: Synthetic peptide
  Seed: SYTWDFGDSSGTLISRALVVTHTYL (PMEL_HUMAN)
  Core: LISRALVVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGTXISXAXVVXHTYL

SEQ ID NO: 338080 - protein, 25 aa, Artificial Sequence
  Description of Artificial Sequence: Synthetic peptide
  Seed: SYTWDFGDSSGTLISRALVVTHTYL (PMEL_HUMAN)
  Core: ISRALVVTH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGTLXSRXLXVTXTYL

SEQ ID NO: 338081 - protein, 25 aa, Artificial Sequence
  Description of Artificial Sequence: Synthetic peptide
  Seed: SYTWDFGDSSGTLISRALVVTHTYL (PMEL_HUMAN)
  Core: SRALVVTHT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
SYTWDFGDSSGTLIXRAXVXTHXYL

SEQ ID NO: 338082 - protein, 13 aa, Artificial Sequence
  Description of Artificial Sequence: Synthetic peptide
  Seed: SYVPLAHSSSAFT (PMEL_HUMAN)
  Core: YVPLAHSSS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVPXAXSSXAFT

SEQ ID NO: 338083 - protein, 13 aa, Artificial Sequence
  Description of Artificial Sequence: Synthetic peptide
  Seed: SYVPLAHSSSAFT (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFX

SEQ ID NO: 338084 - protein, 14 aa, Artificial Sequence
  Description of Artificial Sequence: Synthetic peptide
  Seed: SYVPLAHSSSAFTI (PMEL_HUMAN)
  Core: YVPLAHSSS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVPXAXSSXAFTI

SEQ ID NO: 338085 - protein, 14 aa, Artificial Sequence
  Description of Artificial Sequence: Synthetic peptide
  Seed: SYVPLAHSSSAFTI (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXI

SEQ ID NO: 338086 - protein, 14 aa, Artificial Sequence
  Description of Artificial Sequence: Synthetic peptide
  Seed: SYVPLAHSSSAFTI (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTX

SEQ ID NO: 338087 - protein, 15 aa, Artificial Sequence
  Description of Artificial Sequence: Synthetic peptide
  Seed: SYVPLAHSSSAFTIT (PMEL_HUMAN)
  Core: YVPLAHSSS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVPXAXSSXAFTIT

SEQ ID NO: 338088 - protein, 15 aa, Artificial Sequence
  Description of Artificial Sequence: Synthetic peptide
  Seed: SYVPLAHSSSAFTIT (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXIT

SEQ ID NO: 338089 - protein, 15 aa, Artificial Sequence
  Description of Artificial Sequence: Synthetic peptide
  Seed: SYVPLAHSSSAFTIT (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXT

SEQ ID NO: 338090 - protein, 16 aa, Artificial Sequence
  Description of Artificial Sequence: Synthetic peptide
  Seed: SYVPLAHSSSAFTITD (PMEL_HUMAN)
  Core: YVPLAHSSS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVPXAXSSXAFTITD

SEQ ID NO: 338091 - protein, 16 aa, Artificial Sequence
  Description of Artificial Sequence: Synthetic peptide
  Seed: SYVPLAHSSSAFTITD (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITD

SEQ ID NO: 338092 - protein, 16 aa, Artificial Sequence
  Description of Artificial Sequence: Synthetic peptide
  Seed: SYVPLAHSSSAFTITD (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTD

SEQ ID NO: 338093 - protein, 17 aa, Artificial Sequence
  Description of Artificial Sequence: Synthetic peptide
  Seed: SYVPLAHSSSAFTITDQ (PMEL_HUMAN)
  Core: YVPLAHSSS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
SXVPXAXSSXAFTITDQ

SEQ ID NO: 338094 - protein, 17 aa, Artificial Sequence
  Description of Artificial Sequence: Synthetic peptide
  Seed: SYVPLAHSSSAFTITDQ (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITDQ

SEQ ID NO: 338095 - protein, 17 aa, Artificial Sequence
  Description of Artificial Sequence: Synthetic peptide
  Seed: SYVPLAHSSSAFTITDQ (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTDQ

SEQ ID NO: 338096 - protein, 18 aa, Artificial Sequence
  Description of Artificial Sequence: Synthetic peptide
  Seed: SYVPLAHSSSAFTITDQV (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITDQV

SEQ ID NO: 338097 - protein, 18 aa, Artificial Sequence
  Description of Artificial Sequence: Synthetic peptide
  Seed: SYVPLAHSSSAFTITDQV (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTDQV

SEQ ID NO: 338098 - protein, 19 aa, Artificial Sequence
  Description of Artificial Sequence: Synthetic peptide
  Seed: SYVPLAHSSSAFTITDQVP (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITDQVP

SEQ ID NO: 338099 - protein, 19 aa, Artificial Sequence
  Description of Artificial Sequence: Synthetic peptide
  Seed: SYVPLAHSSSAFTITDQVP (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTDQVP

SEQ ID NO: 338100 - protein, 19 aa, Artificial Sequence
  Description of Artificial Sequence: Synthetic peptide
  Seed: SYVPLAHSSSAFTITDQVP (PMEL_HUMAN)
  Core: HSSSAFTIT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAXSSXAXTIXDQVP

SEQ ID NO: 338101 - protein, 19 aa, Artificial Sequence
  Description of Artificial Sequence: Synthetic peptide
  Seed: SYVPLAHSSSAFTITDQVP (PMEL_HUMAN)
  Core: SSSAFTITD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHXSSXFXITXQVP

SEQ ID NO: 338102 - protein, 19 aa, Artificial Sequence
  Description of Artificial Sequence: Synthetic peptide
  Seed: SYVPLAHSSSAFTITDQVP (PMEL_HUMAN)
  Core: SSAFTITDQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSXSAXTXTDXVP

SEQ ID NO: 338103 - protein, 20 aa, Artificial Sequence
  Description of Artificial Sequence: Synthetic peptide
  Seed: SYVPLAHSSSAFTITDQVPF (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITDQVPF

SEQ ID NO: 338104 - protein, 20 aa, Artificial Sequence
  Description of Artificial Sequence: Synthetic peptide
  Seed: SYVPLAHSSSAFTITDQVPF (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTDQVPF

SEQ ID NO: 338105 - protein, 20 aa, Artificial Sequence
  Description of Artificial Sequence: Synthetic peptide
  Seed: SYVPLAHSSSAFTITDQVPF (PMEL_HUMAN)
  Core: HSSSAFTIT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAXSSXAXTIXDQVPF

SEQ ID NO: 338106 - protein, 20 aa, Artificial Sequence
  Description of Artificial Sequence: Synthetic peptide
  Seed: SYVPLAHSSSAFTITDQVPF (PMEL_HUMAN)
  Core: SSSAFTITD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHXSSXFXITXQVPF

SEQ ID NO: 338107 - protein, 20 aa, Artificial Sequence
  Description of Artificial Sequence: Synthetic peptide
  Seed: SYVPLAHSSSAFTITDQVPF (PMEL_HUMAN)
  Core: SSAFTITDQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSXSAXTXTDXVPF

SEQ ID NO: 338108 - protein, 20 aa, Artificial Sequence
  Description of Artificial Sequence: Synthetic peptide
  Seed: SYVPLAHSSSAFTITDQVPF (PMEL_HUMAN)
  Core: SAFTITDQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSXAFXIXDQXPF

SEQ ID NO: 338109 - protein, 21 aa, Artificial Sequence
  Description of Artificial Sequence: Synthetic peptide
  Seed: SYVPLAHSSSAFTITDQVPFS (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITDQVPFS

SEQ ID NO: 338110 - protein, 21 aa, Artificial Sequence
  Description of Artificial Sequence: Synthetic peptide
  Seed: SYVPLAHSSSAFTITDQVPFS (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTDQVPFS

SEQ ID NO: 338111 - protein, 21 aa, Artificial Sequence
  Description of Artificial Sequence: Synthetic peptide
  Seed: SYVPLAHSSSAFTITDQVPFS (PMEL_HUMAN)
  Core: HSSSAFTIT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAXSSXAXTIXDQVPFS

SEQ ID NO: 338112 - protein, 21 aa, Artificial Sequence
  Description of Artificial Sequence: Synthetic peptide
  Seed: SYVPLAHSSSAFTITDQVPFS (PMEL_HUMAN)
  Core: SSAFTITDQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSXSAXTXTDXVPFS

SEQ ID NO: 338113 - protein, 21 aa, Artificial Sequence
  Description of Artificial Sequence: Synthetic peptide
  Seed: SYVPLAHSSSAFTITDQVPFS (PMEL_HUMAN)
  Core: SAFTITDQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSXAFXIXDQXPFS

SEQ ID NO: 338114 - protein, 21 aa, Artificial Sequence
  Description of Artificial Sequence: Synthetic peptide
  Seed: SYVPLAHSSSAFTITDQVPFS (PMEL_HUMAN)
  Core: FTITDQVPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSSAXTIXDXVPXS

SEQ ID NO: 338115 - protein, 22 aa, Artificial Sequence
  Description of Artificial Sequence: Synthetic peptide
  Seed: SYVPLAHSSSAFTITDQVPFSV (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITDQVPFSV

SEQ ID NO: 338116 - protein, 22 aa, Artificial Sequence
  Description of Artificial Sequence: Synthetic peptide
  Seed: SYVPLAHSSSAFTITDQVPFSV (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTDQVPFSV

SEQ ID NO: 338117 - protein, 22 aa, Artificial Sequence
  Description of Artificial Sequence: Synthetic peptide
  Seed: SYVPLAHSSSAFTITDQVPFSV (PMEL_HUMAN)
  Core: HSSSAFTIT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAXSSXAXTIXDQVPFSV

SEQ ID NO: 338118 - protein, 22 aa, Artificial Sequence
  Description of Artificial Sequence: Synthetic peptide
  Seed: SYVPLAHSSSAFTITDQVPFSV (PMEL_HUMAN)
  Core: SSAFTITDQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSXSAXTXTDXVPFSV

SEQ ID NO: 338119 - protein, 22 aa, Artificial Sequence
  Description of Artificial Sequence: Synthetic peptide
  Seed: SYVPLAHSSSAFTITDQVPFSV (PMEL_HUMAN)
  Core: SAFTITDQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSXAFXIXDQXPFSV

SEQ ID NO: 338120 - protein, 22 aa, Artificial Sequence
  Description of Artificial Sequence: Synthetic peptide
  Seed: SYVPLAHSSSAFTITDQVPFSV (PMEL_HUMAN)
  Core: FTITDQVPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSSAXTIXDXVPXSV

SEQ ID NO: 338121 - protein, 23 aa, Artificial Sequence
  Description of Artificial Sequence: Synthetic peptide
  Seed: SYVPLAHSSSAFTITDQVPFSVS (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITDQVPFSVS

SEQ ID NO: 338122 - protein, 23 aa, Artificial Sequence
  Description of Artificial Sequence: Synthetic peptide
  Seed: SYVPLAHSSSAFTITDQVPFSVS (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTDQVPFSVS

SEQ ID NO: 338123 - protein, 23 aa, Artificial Sequence
  Description of Artificial Sequence: Synthetic peptide
  Seed: SYVPLAHSSSAFTITDQVPFSVS (PMEL_HUMAN)
  Core: HSSSAFTIT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAXSSXAXTIXDQVPFSVS
